(12) United States Patent
Raymond et al.

(10) Patent No.: US 11,319,594 B2
(45) Date of Patent: May 3, 2022

(54) METHODS FOR THE DETECTION OF GENOMIC COPY CHANGES IN DNA SAMPLES

(71) Applicant: Resolution Bioscience, Inc., Bellevue, WA (US)

(72) Inventors: Christopher Raymond, Bellevue, WA (US); Lee Lim, Bellevue, WA (US); Jennifer Hernandez, Bellevue, WA (US)

(73) Assignee: Resolution Bioscience, Inc., Kirkland, WA (US)

( * ) Notice: Subject to any disclaimer, the term of this patent is extended or adjusted under 35 U.S.C. 154(b) by 0 days.

(21) Appl. No.: 15/685,834

(22) Filed: Aug. 24, 2017

(65) Prior Publication Data

US 2018/0163272 A1   Jun. 14, 2018

Related U.S. Application Data

(60) Provisional application No. 62/379,593, filed on Aug. 25, 2016, provisional application No. 62/481,538, filed on Apr. 4, 2017.

(51) Int. Cl.

| | | |
|---|---|---|
| *C12Q 1/6886* | (2018.01) | |
| *G16B 20/00* | (2019.01) | |
| *G16B 30/00* | (2019.01) | |
| *C12Q 1/68* | (2018.01) | |
| *C12Q 1/6809* | (2018.01) | |
| *G16B 30/10* | (2019.01) | |
| *G16B 20/40* | (2019.01) | |
| *G16B 20/10* | (2019.01) | |
| *G16B 25/10* | (2019.01) | |
| *G16B 20/20* | (2019.01) | |
| *C12Q 1/6806* | (2018.01) | |
| *C12Q 1/686* | (2018.01) | |
| *C12Q 1/6869* | (2018.01) | |
| *C12Q 1/6851* | (2018.01) | |
| *C40B 40/08* | (2006.01) | |

(52) U.S. Cl.
CPC ........... *C12Q 1/6886* (2013.01); *C12Q 1/68* (2013.01); *C12Q 1/686* (2013.01); *C12Q 1/6806* (2013.01); *C12Q 1/6809* (2013.01); *C12Q 1/6869* (2013.01); *G16B 20/00* (2019.02); *G16B 20/10* (2019.02); *G16B 20/20* (2019.02); *G16B 20/40* (2019.02); *G16B 25/10* (2019.02); *G16B 30/00* (2019.02); *G16B 30/10* (2019.02); *C12Q 1/6851* (2013.01); *C12Q 2525/191* (2013.01); *C12Q 2545/114* (2013.01); *C12Q 2563/159* (2013.01); *C12Q 2563/179* (2013.01); *C12Q 2600/156* (2013.01); *C40B 40/08* (2013.01); *G01N 2570/00* (2013.01); *G01N 2800/7028* (2013.01)

(58) Field of Classification Search
CPC ...... C12Q 1/6886; C12Q 1/68; C12Q 1/6806; C12Q 1/6809; C12Q 1/686; C12Q 1/6869; C12Q 1/6851; C12Q 2525/191; C12Q 2545/114; C12Q 2563/159; C12Q 2563/179; C12Q 2600/156; G16B 20/00; G16B 30/00; C40B 40/80; G01N 2570/00; G01N 2800/7028
See application file for complete search history.

(56) References Cited

U.S. PATENT DOCUMENTS

| | | |
|---|---|---|
| 5,591,582 A | 1/1997 | Bos et al. |
| 6,025,139 A | 2/2000 | Yager et al. |
| 6,480,791 B1 | 11/2002 | Strathmann |
| 6,812,341 B1 | 11/2004 | Conrad |
| 7,393,665 B2 | 7/2008 | Brenner |
| 8,148,068 B2 | 4/2012 | Brenner |
| 8,168,385 B2 | 5/2012 | Brenner |
| 8,318,433 B2 | 11/2012 | Brenner |
| 8,383,338 B2 | 2/2013 | Kitzman et al. |
| 8,470,996 B2 | 6/2013 | Brenner |
| 8,476,018 B2 | 7/2013 | Brenner |
| 8,828,688 B2 | 9/2014 | Namsaraev |
| 8,835,358 B2 | 9/2014 | Fodor et al. |
| 8,865,410 B2 | 10/2014 | Shendure et al. |
| 9,018,365 B2 | 4/2015 | Brenner |
| 9,085,798 B2 | 7/2015 | Chee |
| 9,121,069 B2 | 9/2015 | Lo et al. |
| 9,290,808 B2 | 3/2016 | Fodor et al. |

(Continued)

FOREIGN PATENT DOCUMENTS

| | | |
|---|---|---|
| CN | 101932729 A | 12/2010 |
| CN | 102439177 A | 5/2012 |

(Continued)

OTHER PUBLICATIONS

Rittie et al. ("Enzymes used in molecular biology: a useful guide" J. Cell Commun. Signal. (2008) 2:25-45).*

(Continued)

*Primary Examiner* — Robert H Havlin
(74) *Attorney, Agent, or Firm* — Cooley LLP

(57) ABSTRACT

The present invention includes compositions and methods useful for the detection of a mutational change, SNP, translocation, inversion, deletion, change in copy number, or other genetic variation within a sample of cellular genomic DNA or cell-free DNA (cfDNA). In some embodiments, the compositions and methods of the present invention provide an extremely high level of resolution that is particularly useful in detecting copy number variations in a small fraction of the total cfDNA from a biological sample (e.g., blood).

56 Claims, 108 Drawing Sheets

Specification includes a Sequence Listing.

(56) References Cited

U.S. PATENT DOCUMENTS

| | | |
|---|---|---|
| 9,290,809 B2 | 3/2016 | Fodor et al. |
| 9,315,857 B2 | 4/2016 | Fu et al. |
| 9,340,830 B2 | 5/2016 | Lipson et al. |
| 9,410,954 B2 | 8/2016 | Boshoff et al. |
| 9,546,399 B2 | 1/2017 | Amorese et al. |
| 9,598,731 B2 | 3/2017 | Talasaz |
| 9,702,002 B2 | 7/2017 | Boutell |
| 9,708,659 B2 | 7/2017 | Fodor et al. |
| 9,783,847 B2 | 10/2017 | Chee |
| 9,792,403 B2 | 10/2017 | Sun et al. |
| 9,816,137 B2 | 11/2017 | Fodor et al. |
| 9,834,822 B2 | 12/2017 | Talasaz |
| 9,840,743 B2 | 12/2017 | Talasaz |
| 9,850,523 B1 | 12/2017 | Chudova et al. |
| 9,902,992 B2 | 2/2018 | Talasaz et al. |
| 9,907,798 B2 | 3/2018 | Boshoff et al. |
| 9,920,366 B2 | 3/2018 | Eltoukhy et al. |
| 9,932,576 B2 | 4/2018 | Raymond et al. |
| 9,965,585 B2 | 5/2018 | Lo et al. |
| 10,000,800 B2 | 6/2018 | Chee |
| 10,047,394 B2 | 8/2018 | Fodor et al. |
| 10,059,991 B2 | 8/2018 | Fodor et al. |
| 10,095,831 B2 | 10/2018 | Duenwald et al. |
| 10,119,165 B2 | 11/2018 | Chee |
| 10,202,646 B2 | 2/2019 | Fodor et al. |
| 10,227,587 B2 | 3/2019 | Zhang et al. |
| 10,240,209 B2 | 3/2019 | Lo et al. |
| 10,266,883 B2 | 4/2019 | Chee |
| 10,266,889 B2 | 4/2019 | Behlke et al. |
| 10,287,630 B2 | 5/2019 | Xie et al. |
| 10,297,342 B2 | 5/2019 | Lo et al. |
| 10,378,064 B1 | 8/2019 | Schutz et al. |
| 10,388,403 B2 | 8/2019 | Rava et al. |
| 10,392,661 B2 | 8/2019 | Fodor et al. |
| 10,453,556 B2 | 10/2019 | Lo et al. |
| 10,494,678 B2 | 12/2019 | Talasaz |
| 10,501,793 B2 | 12/2019 | Chee |
| 10,501,810 B2 | 12/2019 | Talasaz |
| 10,538,759 B2 | 1/2020 | Stuelpnagel et al. |
| 10,577,601 B2 | 3/2020 | Shendure et al. |
| 10,597,653 B2 | 3/2020 | Sabot et al. |
| 10,597,708 B2 | 3/2020 | Zimmermann et al. |
| 10,597,709 B2 | 3/2020 | Zimmermann et al. |
| 10,619,203 B2 | 4/2020 | Fodor et al. |
| 10,619,214 B2 | 4/2020 | Lo et al. |
| 10,689,699 B2 | 6/2020 | Salk et al. |
| 10,704,085 B2 | 7/2020 | Talasaz et al. |
| 10,704,086 B2 | 7/2020 | Talasaz et al. |
| 10,741,270 B2 | 8/2020 | Lo et al. |
| 10,752,951 B2 | 8/2020 | Salk et al. |
| 10,793,916 B2 | 10/2020 | Talasaz |
| 10,801,063 B2 | 10/2020 | Eltoukhy et al. |
| 10,847,249 B2 | 11/2020 | Sun et al. |
| 10,876,152 B2 | 12/2020 | Talasaz et al. |
| 10,883,139 B2 | 1/2021 | Eltoukhy et al. |
| 10,889,858 B2 | 1/2021 | Talasaz et al. |
| 10,894,974 B2 | 1/2021 | Talasaz et al. |
| 10,907,149 B2 | 2/2021 | Raymond et al. |
| 2003/0148310 A1 | 8/2003 | Sorge |
| 2004/0058328 A1 | 3/2004 | Chan et al. |
| 2005/0032057 A1 | 2/2005 | Shoemaker |
| 2007/0037139 A1 | 2/2007 | Tomono et al. |
| 2007/0128624 A1 | 6/2007 | Gormley et al. |
| 2007/0172873 A1 | 7/2007 | Brenner et al. |
| 2008/0038782 A1 | 2/2008 | Borns |
| 2009/0117573 A1 | 5/2009 | Fu et al. |
| 2009/0143243 A1 | 6/2009 | Gunning et al. |
| 2009/0191563 A1 | 7/2009 | Steemers et al. |
| 2009/0264305 A1 | 10/2009 | Brandon et al. |
| 2010/0093550 A1 | 4/2010 | Stuelpnagel et al. |
| 2010/0273219 A1 | 10/2010 | May et al. |
| 2011/0014657 A1 | 1/2011 | Rigatti et al. |
| 2011/0160078 A1 | 6/2011 | Fodor et al. |
| 2011/0294689 A1 | 12/2011 | Namsaraev |
| 2011/0313145 A1 | 12/2011 | Sharon et al. |
| 2012/0157322 A1 | 6/2012 | Myllykangas et al. |
| 2013/0288915 A1 | 10/2013 | Seligmann et al. |
| 2014/0100792 A1 | 4/2014 | Deciu et al. |
| 2014/0242581 A1 | 8/2014 | Johnson |
| 2014/0274731 A1 | 9/2014 | Raymond et al. |
| 2014/0274740 A1 | 9/2014 | Srinivasan et al. |
| 2015/0046180 A1 | 2/2015 | Futscher De Deus et al. |
| 2015/0072344 A1 | 3/2015 | Wiley |
| 2015/0111757 A1 | 4/2015 | Boyden et al. |
| 2015/0159222 A1 | 6/2015 | Gaulis et al. |
| 2015/0275289 A1 | 10/2015 | Otwinowski et al. |
| 2015/0376700 A1 | 12/2015 | Schnall-levin et al. |
| 2016/0053253 A1 | 2/2016 | Salathia et al. |
| 2016/0053301 A1 | 2/2016 | Raymond et al. |
| 2017/0088887 A1* | 3/2017 | Makarov .............. C12Q 1/6806 |
| 2017/0096706 A1 | 4/2017 | Behlke et al. |
| 2017/0242960 A1 | 8/2017 | Rabinowitz et al. |
| 2017/0283869 A1 | 10/2017 | Fang et al. |
| 2017/0355984 A1 | 12/2017 | Evans et al. |
| 2017/0356053 A1 | 12/2017 | Otto et al. |
| 2018/0142234 A1 | 5/2018 | Raymond et al. |
| 2018/0179578 A1 | 6/2018 | Raymond et al. |
| 2018/0245072 A1 | 8/2018 | Raymond et al. |
| 2018/0300449 A1 | 10/2018 | Kermani et al. |
| 2018/0300456 A1 | 10/2018 | Eltoukhy et al. |
| 2018/0363066 A1 | 12/2018 | Chalmers et al. |
| 2019/0032118 A1 | 1/2019 | Lipson et al. |
| 2019/0136301 A1 | 5/2019 | Lipson et al. |
| 2019/0233897 A1 | 8/2019 | Cronin et al. |
| 2020/0048703 A1 | 2/2020 | Chee |
| 2020/0299775 A1 | 9/2020 | Hawryluk et al. |
| 2021/0198658 A1 | 7/2021 | Raymond et al. |

FOREIGN PATENT DOCUMENTS

| | | |
|---|---|---|
| CN | 103103624 A | 5/2013 |
| CN | 103668471 A | 3/2014 |
| EP | 3192869 A1 | 7/2017 |
| EP | 3202915 A1 | 8/2017 |
| EP | 3363904 A2 | 8/2018 |
| EP | 3421613 A1 | 1/2019 |
| EP | 3470533 A1 | 4/2019 |
| EP | 3502273 A1 | 6/2019 |
| EP | 3551769 A2 | 10/2019 |
| EP | 3567120 A1 | 11/2019 |
| JP | 2013-536679 A | 9/2013 |
| JP | 2014-512817 A | 5/2014 |
| JP | 2020-516281 A | 6/2020 |
| WO | WO 1999/011819 A1 | 3/1999 |
| WO | WO 2004/053127 A1 | 6/2004 |
| WO | WO 2009/076238 A2 | 6/2009 |
| WO | WO 2009/091798 A1 | 7/2009 |
| WO | WO 2010/129937 A2 | 11/2010 |
| WO | WO 2011/156529 A2 | 12/2011 |
| WO | WO 2012/028746 A1 | 3/2012 |
| WO | WO 2012/040387 A1 | 3/2012 |
| WO | WO 2012/129363 A2 | 9/2012 |
| WO | WO 2012/142213 A2 | 10/2012 |
| WO | WO 2012/142334 A2 | 10/2012 |
| WO | WO 2012/148477 A1 | 11/2012 |
| WO | WO 2014/052487 A1 | 4/2014 |
| WO | WO 2014/055790 A2 | 4/2014 |
| WO | WO 2014/071295 A1 | 5/2014 |
| WO | WO 2014/093330 A1 | 6/2014 |
| WO | WO 2014/093825 A1 | 6/2014 |
| WO | WO 2014/122288 A1 | 8/2014 |
| WO | WO 2015/134552 A1 | 9/2014 |
| WO | WO 2015/117040 A1 | 8/2015 |
| WO | WO 2015/134552 A1 | 9/2015 |
| WO | WO 2016/022833 A1 | 2/2016 |
| WO | WO 2016/028316 A1 | 2/2016 |
| WO | WO 2016/037389 A1 | 3/2016 |
| WO | WO 2016/040901 A1 | 3/2016 |
| WO | WO 2016/094853 A1 | 6/2016 |
| WO | WO 2016/109452 A1 | 7/2016 |
| WO | WO 2017/083562 A1 | 5/2017 |
| WO | WO 2018/039463 A1 | 3/2018 |
| WO | WO 2018/064629 A1 | 4/2018 |

(56) References Cited

FOREIGN PATENT DOCUMENTS

| WO | WO 2018/094183 A1 | 5/2018 |
|---|---|---|
| WO | WO 2018/104908 A2 | 6/2018 |
| WO | WO 2020/106906 A1 | 5/2020 |

OTHER PUBLICATIONS

Atamaniuk et al., "Cell-free plasma DNA: a marker for apoptosis during hemodialysis." Clinical Chemistry (2006); 52.3: 523-526.
Blake, R. D., and Delcourt, S.G. "Thermodynamic effects of formamide on DNA stability." Nucleic Acids Research (1996); 24.11:2095-2103.
Chan et al. "Cancer genome scanning in plasma: detection of tumor-associated copy number aberrations, singlenucleotide variants, and tu moral heterogeneity by massively parallel sequencing." Clinical Chemistry (2013); 59(1): 211-224.
Extended European Search Report in Application No. EP 13862440. 8, dated Oct. 11, 2016, 19 pages.
Hoeijmakers et al., "Linear amplification for deep sequencing." Nature Protocols (2011); 6.7:1026-1036.
KAPA Biosystems "KAPA Library Quantification Kits Technical Data Sheet" (2011); 6 pages, www.kapabiosystems.com.
Leary et al. "Detection of chromosomal alterations in the circulation of cancer patients with whole-genome sequencing." Science Translational Medicine (2012); 4(162):162ra154.
Lin et al., "Exon array profiling detects EML4-ALK fusion in breast, colorectal, and non-small cell lung cancers." Molecular Cancer Research (2009); 7.9:1466-1476.
Mano, H., "Non-solid oncogenes in solid tumors: EML4-ALK fusion genes in lung cancer." Cancer Science (2008); 99.12:2349-2355.
McKernan et al., "Sequence and structural variation in a human genome uncovered by short-read, massively parallel ligation sequencing using two-base encoding." Genome Research (2009); 19.9: 1527-1541.
Melchior, W.B. and Hippel, P.H. "Alteration of the relative stability of dA• dT and dG• dC base pairs in DNA." Proceedings of the National Academy of Sciences USA (1973); 70.2: 298-302.
Meyer et al., "Targeted high-throughput sequencing of tagged nucleic acid samples." Nucleic Acids Research (2007); 35.15: e97, 5 pages.
Meyer et al., "From micrograms to picograms: quantitative PCR reduces the material demands of high-throughput sequencing" Nucleic Acids Research (2008); 36(1 ):e5.
Partial Supplementary European Search Report in European Application No. 13862440.8 dated Jul. 4, 2016, 11 pages.
PCT/US2013/074102, International Preliminary Report on Patentability dated Jun. 16, 2015.
PCT/US2014/052317, International Preliminary Report on Patentability dated Feb. 28, 2017, 8 pages.
PCT/US2013/074102, International Search Report and Written Opinion dated Feb. 28, 2014.
PCT/US2014/052317, International Search Report and Written Opinion dated Jan. 13, 2015, 13 pages.
PCT/US2016/061395, International Search Report and Written Opinion dated Feb. 7, 2017, 14 pages.
PCT/US2017/048434, International Search Report and Written Opinion dated Dec. 26, 2017, 15 pages.
Samorodnitsky, et al., "Comparison of Custom Capture for Targeted Next-Generation DNA Sequencing." The Journal of Molecular Diagnostics (2015); 17(1): 64-75.
Shevelev and Hübscher, "The 3' 5' exonucleases", *Nat Rev Mol Cell Biol.*, 3(5): 364-376 (2002).
Shiroguchi, et al., "Digital RNA sequencing minimizes sequence-dependent bias and amplification noise with optimized single-molecule barcodes." PNAS (2012); 109(4): 1347-1352, Supporting Information, 14 pages.
Stellwagen, Earle, et al. "Monovalent cation size and DNA conformational stability." Biochemistry (2011); 50.15: 3084-3094.

Taton, T. Andrew, et al. "Scanometric DNA array detection with nanoparticle probes." Science (2000); 289.5485: 1757-1760.
Vogelstein et al., "Cancer genome landscapes." Science (2013); 339.6127: 1546-1558.
Yegnasubramanian et al., "Preparation of Fragment Libraries for Next-Generation Sequencing on the Applied Biosystems SOLiD Platform." Methods in Enzymology (2013); 529: 185-200.
Horn, Susanne, "Target Enrichment via DNA Hybridization Capture" in Ancient DNA: Methods and Protocols, Methods in Molecular Biology (2012); 840: 177-188. Epub Dec. 8, 2011.
PCT/US2017/048434, International Preliminary Reporton Patentability dated Feb. 26, 2019, 10 pages.
Cheng, et al., "Memorial Sloan Kettering-Integrated Mutation Profiling of Actionable Cancer Targets (MSK-IMPACT): A Hybridization Capture-Based Next-Generation Sequencing Clinical Assay for Solid Tumor Molecular Oncology". J Mol Diagn. (May 2015); 17(3): 251-264. Epub Mar. 20, 2015.
Extended European Search Report in Application No. EP 17844424. 6, dated Mar. 27, 2020, 8 pages.
Miura, et al., "Highly efficient single-stranded DNA ligation technique improves low-input whole-genome bisulfite sequencing by post-bisulfite adaptor tagging." Nucleic Acids Research 47.15 (2019): e85-e85.
[Author Unknown] "SureSelectXT Target Enrichment System for Illumina Paired-End Multiplexed Sequencing Library". Protocol, Version C3, Sep. 2019, Agilent Technologies, ©Agilent Technologies, Inc. 2010-2019, 100 pages.
Wisegeek, "How many species of bacteria are there?" WiseGeek. com, accessed Jan. 21, 2014, 2 pages. (Year: 2014).
Wikipedia, "List of sequenced bacterial genomes" Wikipedia.com, accessed Jan. 24, 2014, 57 pages. (Year: 2014).
Begley, Sharon, "Psst, The Human Genome Was Never Completely Sequenced. Some Scientists Say It Should Be", STAT News, Jun. 20, 2017 (Year: 2017), downloaded Sep. 3, 2018 from https://www.statnews.com/2017 /06/20/human-genome-not-fully-sequenced/, 8 pages.
Extended European Search Report in Application No. EP 16865029. 9, dated Apr. 29, 2019, 11 pages.
Extended European Search Report in Application No. EP 19153893. 3, dated Sep. 17, 2019, 9 pages.
Extended European Search Report in Application No. EP 21152311. 3, dated Sep. 7, 2021, 14 pages.
Fakruddin, et al., "Nucleic acid amplification: Alternative methods of polymerase chain reaction". Journal of Pharmacy and Bioallied Sciences (Oct. 2013-Dec.); 5(4): 245-252.
Forster, et al., "A human gut bacterial genome and culture collection for improved metagenomic analyses". Nat Biotechnol. (Feb. 2019); 37(2): 186-192. Epub Feb. 4, 2019.
Jacobs, et al., "The thermal stability of oligonucleotide duplexes is sequence independent in tetraalkylammonium salt solutions: application to identifying recombinant DNA clones". Nucleic Acids Res. (May 25, 1988); 16(10): 4637-4650.
PCT/US2016/061395, International Preliminary Report on Patentability dated May 15, 2018, 10 pages.
Piovesan, et al., "On the length, weight and GC content of the human genome". BMC Res Notes (Feb. 27, 2019); 12:106, 7 pages.
Shevelev and Hübscher, "The 3' 5' exonucleases", Nat Rev Mol Cell Biol. (May 2002); 3(5): 364-376.
Oxford Dictionary of Biochemistry and Molecular Biology, Definition of "base composition," general eds Attwood, et al. Revised Edition (2000), 3 pages.
Beltran, et al., "Circulating tumor DNA profile recognizes transformation to castration-resistant neuroendocrine prostate cancer". J Clin Invest (Apr. 1, 2020); 130(4): 1653-1668.
Zhou, et al., "Systematic evaluation of library preparation methods and sequencing platforms for high-throughput whole genome bisulfite sequencing." Scientific Reports (2019); 9:10383,16 pages.
PCT/US2021/049448, International Search Report and Written Opinion dated Dec. 28, 2021, 12 pages.
[Author Unknown] "TruSeq™ RNA and DNA Library Preparation Kits v2". Data Sheet: Illumina® Sequencing, ©2011,2014 Illumina, Inc., Pub. No. 770-2009-039 Current as ☐ of Nov. 17, 2014, 4 pages.

(56) References Cited

OTHER PUBLICATIONS

Hess, et al., "Library preparation for next generation sequencing: A review of automation strategies". Biotechnol Adv. (Jul.-Aug. 2020); 41: 107537, 14 pages. Epub ☐ Mar. 19, 2020.

Hong and Shin, "Bisulfite-Converted DNA Quantity Evaluation: A Multiplex Quantitative Real-Time PCR System for Evaluation of Bisulfite Conversion". Front ☐ Genet. (Feb. 25, 2021); 12: 618955. eCollection 2021.

Ma, et al., "Pan-cancer genome and transcriptome analyses of 1,699 paediatric -leukaemias and solid tumours". Nature (2018); 55: 371-376. Epub Feb. 28, 2018.

Malone, et al., "Molecular profiling for precision cancer therapies". Genome Med. -(Jan. 14, 2020); 12(1): 8, 19 pages.

Mamanova, et al., "Target-enrichment strategies for next-generation sequencing". Nature Methods. (Feb. 2010); 7(2): 111-118.

Manier, et al., "Whole-exome sequencing of cell-free DNA and circulating tumor cells -in multiple myeloma". Nat Commun. (Apr. 2, 20187); 9(1): 1691, 11 pages.

Wang, et al., "Enzymatic approaches for profiling cytosine methylation and -hydroxymethylation". Mol Metab. (Mar. 2022); 57: 101314. Epub Aug. 8, 2021.

Wang, et al., "Low-pass genome sequencing versus chromosomal microarray analysis: implementation in prenatal diagnosis". Genet Med. (Mar. 2020); 22(3): 500- ☐ 510. Epub Aug. 26, 2019.

\* cited by examiner 249 tags → 1 anchor sequence

FIG. 8A
| Sample | Input |
|---|---|
| Sample 1 | Female gDNA + 8% BRCA2 delete |
| Sample 2 | Female gDNA + 4% BRCA2 delete |
| Sample 3 | Female gDNA + 2% BRCA2 delete |
| Sample 4 | Pure Female gDNA |
| Sample 5 | Female gDNA + 8% ATM delete |
| Sample 6 | Female gDNA + 4% ATM delete |
| Sample 7 | Female gDNA + 2% ATM delete |
| Sample 8 | Pure Female gDNA |
FIG. 8B
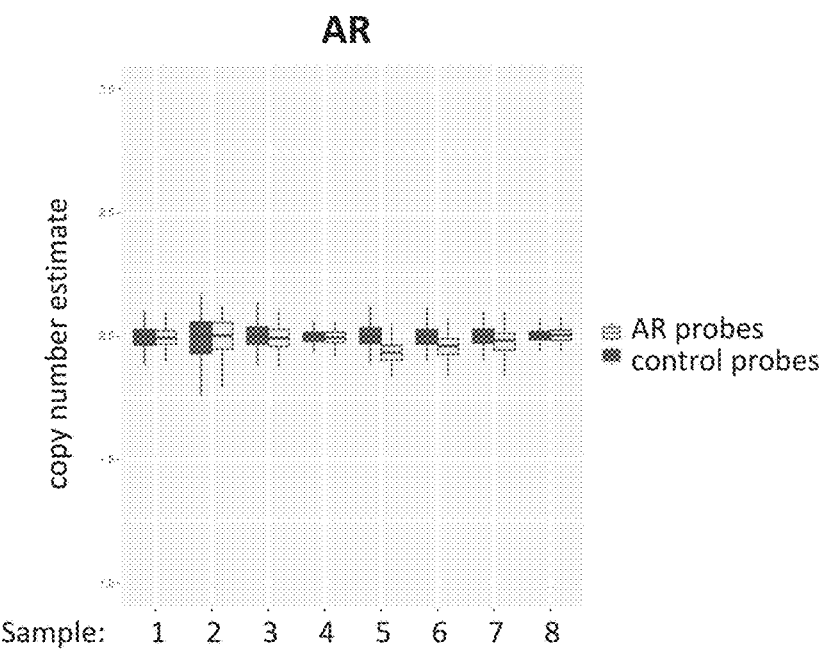
FIG. 8C
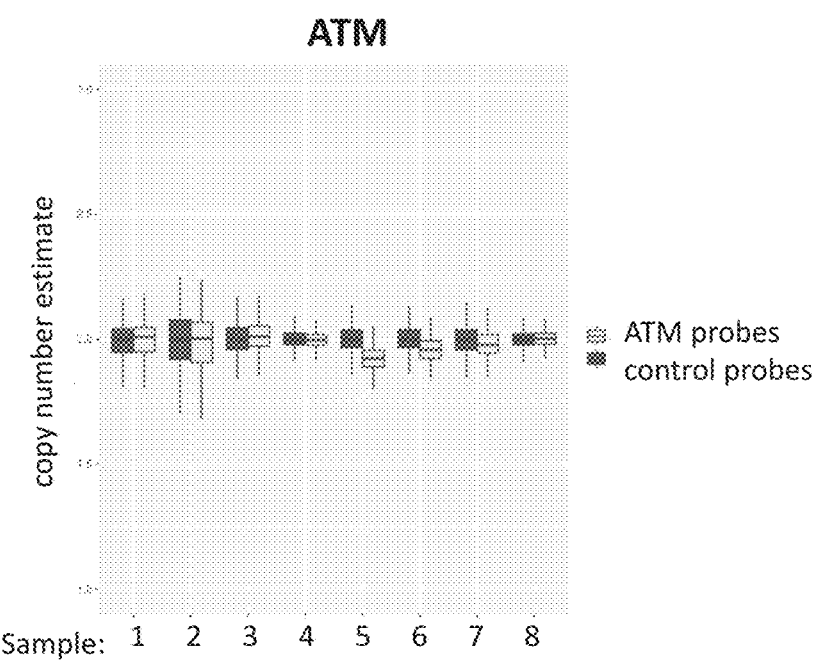

| Sample | Input |
|---|---|
| Sample 1 | Female gDNA + 8% BRCA2 delete |
| Sample 2 | Female gDNA + 4% BRCA2 delete |
| Sample 3 | Female gDNA + 2% BRCA2 delete |
| Sample 4 | Pure Female gDNA |
| Sample 5 | Female gDNA + 8% ATM delete |
| Sample 6 | Female gDNA + 4% ATM delete |
| Sample 7 | Female gDNA + 2% ATM delete |
| Sample 8 | Pure Female gDNA |

| Sample | Input |
|---|---|
| Sample 1 | F_cfDNA + 10% M_cfDNA |
| Sample 2 | F_cfDNA + 5% M_cfDNA |
| Sample 3 | Pure F_cfDNA |
| Sample 4 | Pure F_cfDNA |
| Sample 5 | F_cfDNA + 10% ATM |
| Sample 6 | F_cfDNA + 5% ATM |
| Sample 7 | F_cfDNA + 10% BRCA2 |
| Sample 8 | F_cfDNA + 5% BRCA2 |

Measured ΔATM SNP frequency:          5.5   2.5
Measured ΔBRCA2 SNP frequency:                      7.2   2.6

Distribution of targeted sequencing reads

Unique  Duplicate  Off target  Unalignable

FIG. 12A

| Pool-1 | SEQ ID NO: | Pool-2 | SEQ ID NO: | Pool-3 | SEQ ID NO: |
|---|---|---|---|---|---|
| TGCAGGACCAGAGAATTCGAATA CACGAGCTTANNNACGTATGCCA | 9 | TGCAGGACCAGAGAATTCGAATA CACCCTGTCGNNNACGTATGCCA | 249 | TGCAGGACCAGAGAATTCGAATA CAACGTCAACNNNACGTATGCCA | 489 |
| TGCAGGACCAGAGAATTCGAATA CATTGCTCACNNNACGTATGCCA | 10 | TGCAGGACCAGAGAATTCGAATA CATATCAATGNNNACGTATGCCA | 250 | TGCAGGACCAGAGAATTCGAATA CAGTGTCTAGNNNACGTATGCCA | 490 |
| TGCAGGACCAGAGAATTCGAATA CATAATACACNNNACGTATGCCA | 11 | TGCAGGACCAGAGAATTCGAATA CACTGCAGATNNNACGTATGCCA | 251 | TGCAGGACCAGAGAATTCGAATA CAGCGGCCAGTNNNACGTATGCCA | 491 |
| TGCAGGACCAGAGAATTCGAATA CATCAGCATGNNNACGTATGCCA | 12 | TGCAGGACCAGAGAATTCGAATA CAATCGGATCNNNACGTATGCCA | 252 | TGCAGGACCAGAGAATTCGAATA CAGCTCTGAANNNACGTATGCCA | 492 |
| TGCAGGACCAGAGAATTCGAATA CAACTGTAGCNNNACGTATGCCA | 13 | TGCAGGACCAGAGAATTCGAATA CACTGTTCCANNNACGTATGCCA | 253 | TGCAGGACCAGAGAATTCGAATA CAAGACTTGCNNNACGTATGCCA | 493 |
| TGCAGGACCAGAGAATTCGAATA CAATTATGCANNNACGTATGCCA | 14 | TGCAGGACCAGAGAATTCGAATA CATCACATTTNNNACGTATGCCA | 254 | TGCAGGACCAGAGAATTCGAATA CAGATGGTCTNNNACGTATGCCA | 494 |
| TGCAGGACCAGAGAATTCGAATA CATGACCTTCNNNACGTATGCCA | 15 | TGCAGGACCAGAGAATTCGAATA CAGCGTGGCTNNNACGTATGCCA | 255 | TGCAGGACCAGAGAATTCGAATA CATTGTGAATNNNACGTATGCCA | 495 |
| TGCAGGACCAGAGAATTCGAATA CAAAAATCCTNNNACGTATGCCA | 16 | TGCAGGACCAGAGAATTCGAATA CACGGAGTAANNNACGTATGCCA | 256 | TGCAGGACCAGAGAATTCGAATA CACAGCGCGTNNNACGTATGCCA | 496 |
| TGCAGGACCAGAGAATTCGAATA CAGGTTCCGGNNNACGTATGCCA | 17 | TGCAGGACCAGAGAATTCGAATA CAGTGTCCGGNNNACGTATGCCA | 257 | TGCAGGACCAGAGAATTCGAATA CATGCCAAGTNNNACGTATGCCA | 497 |
| TGCAGGACCAGAGAATTCGAATA CAACGTGCATNNNACGTATGCCA | 18 | TGCAGGACCAGAGAATTCGAATA CATATTGTAGNNNACGTATGCCA | 258 | TGCAGGACCAGAGAATTCGAATA CACGTCGTTTNNNACGTATGCCA | 498 |
| TGCAGGACCAGAGAATTCGAATA CACGCCCCATNNNACGTATGCCA | 19 | TGCAGGACCAGAGAATTCGAATA CATAGTATTGNNNACGTATGCCA | 259 | TGCAGGACCAGAGAATTCGAATA CACCAACGGCNNNACGTATGCCA | 499 |
| TGCAGGACCAGAGAATTCGAATA CAGTAAGCCTNNNACGTATGCCA | 20 | TGCAGGACCAGAGAATTCGAATA CAAGCGCTTANNNACGTATGCCA | 260 | TGCAGGACCAGAGAATTCGAATA CACAGTTATANNNACGTATGCCA | 500 |
| TGCAGGACCAGAGAATTCGAATA CAAGTAATAGNNNACGTATGCCA | 21 | TGCAGGACCAGAGAATTCGAATA CATGCAGGTTNNNACGTATGCCA | 261 | TGCAGGACCAGAGAATTCGAATA CACGAAGGCGNNNACGTATGCCA | 501 |
| TGCAGGACCAGAGAATTCGAATA CAAAGTCCANNNACGTATGCCA | 22 | TGCAGGACCAGAGAATTCGAATA CACCTCCGGTNNNACGTATGCCA | 262 | TGCAGGACCAGAGAATTCGAATA CAATGGCTACNNNACGTATGCCA | 502 |
| TGCAGGACCAGAGAATTCGAATA CAAGTGCATCNNNACGTATGCCA | 23 | TGCAGGACCAGAGAATTCGAATA CAAGACGGATNNNACGTATGCCA | 263 | TGCAGGACCAGAGAATTCGAATA CATCGCATGANNNACGTATGCCA | 503 |
| TGCAGGACCAGAGAATTCGAATA CAGACATATTNNNACGTATGCCA | 24 | TGCAGGACCAGAGAATTCGAATA CATCTGTCTGNNNACGTATGCCA | 264 | TGCAGGACCAGAGAATTCGAATA CAATATCCTTNNNACGTATGCCA | 504 |
| TGCAGGACCAGAGAATTCGAATA CAGTCCACAANNNACGTATGCCA | 25 | TGCAGGACCAGAGAATTCGAATA CATTCACCGTNNNACGTATGCCA | 265 | TGCAGGACCAGAGAATTCGAATA CATGAAGCAGNNNACGTATGCCA | 505 |
| TGCAGGACCAGAGAATTCGAATA CATCTCAGAGNNNACGTATGCCA | 26 | TGCAGGACCAGAGAATTCGAATA CACGTAAGGNNNNACGTATGCCA | 266 | TGCAGGACCAGAGAATTCGAATA CAGACCACCGNNNACGTATGCCA | 506 |
| TGCAGGACCAGAGAATTCGAATA CAAAAACGTANNNACGTATGCCA | 27 | TGCAGGACCAGAGAATTCGAATA CAAGAAAGAANNNACGTATGCCA | 267 | TGCAGGACCAGAGAATTCGAATA CAAGATTAGANNNACGTATGCCA | 507 |
| TGCAGGACCAGAGAATTCGAATA CACTACCAAGNNNACGTATGCCA | 28 | TGCAGGACCAGAGAATTCGAATA CAAGTAGTTTNNNACGTATGCCA | 268 | TGCAGGACCAGAGAATTCGAATA CAAGATCTATNNNACGTATGCCA | 508 |
| TGCAGGACCAGAGAATTCGAATA CACCCTGACTTNNNACGTATGCCA | 29 | TGCAGGACCAGAGAATTCGAATA CAGGTACCTANNNACGTATGCCA | 269 | TGCAGGACCAGAGAATTCGAATA CAACGTACACNNNACGTATGCCA | 509 |
| TGCAGGACCAGAGAATTCGAATA CACTCCTATGNNNACGTATGCCA | 30 | TGCAGGACCAGAGAATTCGAATA CAGAAGCACANNNACGTATGCCA | 270 | TGCAGGACCAGAGAATTCGAATA CACGGTTACANNNACGTATGCCA | 510 |
| TGCAGGACCAGAGAATTCGAATA CAATCATGATNNNACGTATGCCA | 31 | TGCAGGACCAGAGAATTCGAATA CACTAATAACNNNACGTATGCCA | 271 | TGCAGGACCAGAGAATTCGAATA CAAAACCTATNNNACGTATGCCA | 511 |
| TGCAGGACCAGAGAATTCGAATA CATGACGGTTNNNACGTATGCCA | 32 | TGCAGGACCAGAGAATTCGAATA CAACGGACAANNNACGTATGCCA | 272 | TGCAGGACCAGAGAATTCGAATA CACTGATTTTNNNACGTATGCCA | 512 |
| TGCAGGACCAGAGAATTCGAATA CAGTCGGCGTNNNACGTATGCCA | 33 | TGCAGGACCAGAGAATTCGAATA CAATCCAGTGNNNACGTATGCCA | 273 | TGCAGGACCAGAGAATTCGAATA CATGAATATCNNNACGTATGCCA | 513 |
| TGCAGGACCAGAGAATTCGAATA CAGTTACCCTNNNACGTATGCCA | 34 | TGCAGGACCAGAGAATTCGAATA CAGGACAACANNNACGTATGCCA | 274 | TGCAGGACCAGAGAATTCGAATA CAACTGCGCGNNNACGTATGCCA | 514 |
| TGCAGGACCAGAGAATTCGAATA CACTTAACGGNNNACGTATGCCA | 35 | TGCAGGACCAGAGAATTCGAATA CAGAAAGTTANNNACGTATGCCA | 275 | TGCAGGACCAGAGAATTCGAATA CAGAACGACANNNACGTATGCCA | 515 |
| TGCAGGACCAGAGAATTCGAATA CACGCTCCTGNNNACGTATGCCA | 36 | TGCAGGACCAGAGAATTCGAATA CAAACACAGGNNNACGTATGCCA | 276 | TGCAGGACCAGAGAATTCGAATA CATATATTGGNNNACGTATGCCA | 516 |
| TGCAGGACCAGAGAATTCGAATA CATCTCGGTTNNNACGTATGCCA | 37 | TGCAGGACCAGAGAATTCGAATA CACCAGAATCNNNACGTATGCCA | 277 | TGCAGGACCAGAGAATTCGAATA CATAGATGCCNNNACGTATGCCA | 517 |
| TGCAGGACCAGAGAATTCGAATA CAGCTCGAGCNNNACGTATGCCA | 38 | TGCAGGACCAGAGAATTCGAATA CATTCACCACNNNACGTATGCCA | 278 | TGCAGGACCAGAGAATTCGAATA CAGCAAGTAGNNNACGTATGCCA | 518 |
| TGCAGGACCAGAGAATTCGAATA CACGCTTCGCNNNACGTATGCCA | 39 | TGCAGGACCAGAGAATTCGAATA CATGGAGANNNNACGTATGCCA | 279 | TGCAGGACCAGAGAATTCGAATA CAAACGACCTNNNACGTATGCCA | 519 |
| TGCAGGACCAGAGAATTCGAATA CAATCCAGACNNNACGTATGCCA | 40 | TGCAGGACCAGAGAATTCGAATA CACGATGTCANNNACGTATGCCA | 280 | TGCAGGACCAGAGAATTCGAATA CAGTACAGTCNNNACGTATGCCA | 520 |
| TGCAGGACCAGAGAATTCGAATA CATAGCACTGNNNACGTATGCCA | 41 | TGCAGGACCAGAGAATTCGAATA CACGGCAGGANNNACGTATGCCA | 281 | TGCAGGACCAGAGAATTCGAATA CATATGCGGTNNNACGTATGCCA | 521 |

FIG. 12B

| Pool-1 | SEQ ID NO: | Pool-2 | SEQ ID NO: | Pool-3 | SEQ ID NO: |
|---|---|---|---|---|---|
| TGCAGGACCAGAGAATTCGAATACACTGGCTTTNNNACGTATGCCA | 42 | TGCAGGACCAGAGAATTCGAATACAAGAACCAGNNNACGTATGCCA | 282 | TGCAGGACCAGAGAATTCGAATACAATAATAGGNNNACGTATGCCA | 522 |
| TGCAGGACCAGAGAATTCGAATACAGCAAATGGNNNACGTATGCCA | 43 | TGCAGGACCAGAGAATTCGAATACAGATTTTGANNNACGTATGCCA | 283 | TGCAGGACCAGAGAATTCGAATACAGTTACTAANNNACGTATGCCA | 523 |
| TGCAGGACCAGAGAATTCGAATACAGGATGACANNNACGTATGCCA | 44 | TGCAGGACCAGAGAATTCGAATACAAACACGTCNNNACGTATGCCA | 284 | TGCAGGACCAGAGAATTCGAATACACCCTTGTANNNACGTATGCCA | 524 |
| TGCAGGACCAGAGAATTCGAATACAGCCCCACTNNNACGTATGCCA | 45 | TGCAGGACCAGAGAATTCGAATACAACCTCTACNNNACGTATGCCA | 285 | TGCAGGACCAGAGAATTCGAATACAACATTTCTNNNACGTATGCCA | 525 |
| TGCAGGACCAGAGAATTCGAATACACTAGCCGGNNNACGTATGCCA | 46 | TGCAGGACCAGAGAATTCGAATACAGGCGTTTANNNACGTATGCCA | 286 | TGCAGGACCAGAGAATTCGAATACACCGACTTTNNNACGTATGCCA | 526 |
| TGCAGGACCAGAGAATTCGAATACACCCTCCTCNNNACGTATGCCA | 47 | TGCAGGACCAGAGAATTCGAATACACCCGAAGCNNNACGTATGCCA | 287 | TGCAGGACCAGAGAATTCGAATACATATGAACTNNNACGTATGCCA | 527 |
| TGCAGGACCAGAGAATTCGAATACATGTAGTGCNNNACGTATGCCA | 48 | TGCAGGACCAGAGAATTCGAATACATACCTACCNNNACGTATGCCA | 288 | TGCAGGACCAGAGAATTCGAATACATTCTTTTCNNNACGTATGCCA | 528 |
| TGCAGGACCAGAGAATTCGAATACAGAATGTGGNNNACGTATGCCA | 49 | TGCAGGACCAGAGAATTCGAATACATTTACGCCNNNACGTATGCCA | 289 | TGCAGGACCAGAGAATTCGAATACAATAGGTTTNNNACGTATGCCA | 529 |
| TGCAGGACCAGAGAATTCGAATACAAATGATCTNNNACGTATGCCA | 50 | TGCAGGACCAGAGAATTCGAATACAAGGTATGGNNNACGTATGCCA | 290 | TGCAGGACCAGAGAATTCGAATACACGACGTTANNNACGTATGCCA | 530 |
| TGCAGGACCAGAGAATTCGAATACACACTAACGNNNACGTATGCCA | 51 | TGCAGGACCAGAGAATTCGAATACAACTACAATNNNACGTATGCCA | 291 | TGCAGGACCAGAGAATTCGAATACAAGCATAGGNNNACGTATGCCA | 531 |
| TGCAGGACCAGAGAATTCGAATACACGTCGGACNNNACGTATGCCA | 52 | TGCAGGACCAGAGAATTCGAATACACTCCTCAANNNACGTATGCCA | 292 | TGCAGGACCAGAGAATTCGAATACACTGCATCTNNNACGTATGCCA | 532 |
| TGCAGGACCAGAGAATTCGAATACAGCAACTTGNNNACGTATGCCA | 53 | TGCAGGACCAGAGAATTCGAATACAGATACAAANNNACGTATGCCA | 293 | TGCAGGACCAGAGAATTCGAATACACGACGCCANNNACGTATGCCA | 533 |
| TGCAGGACCAGAGAATTCGAATACACGGTGGAGNNNACGTATGCCA | 54 | TGCAGGACCAGAGAATTCGAATACACCAACACANNNACGTATGCCA | 294 | TGCAGGACCAGAGAATTCGAATACAAACGCCCGNNNACGTATGCCA | 534 |
| TGCAGGACCAGAGAATTCGAATACAGTAACCGTNNNACGTATGCCA | 55 | TGCAGGACCAGAGAATTCGAATACAACCCATTCNNNACGTATGCCA | 295 | TGCAGGACCAGAGAATTCGAATACACTCTCGATNNNACGTATGCCA | 535 |
| TGCAGGACCAGAGAATTCGAATACATAGTTTTCNNNACGTATGCCA | 56 | TGCAGGACCAGAGAATTCGAATACATCTAAGCGNNNACGTATGCCA | 296 | TGCAGGACCAGAGAATTCGAATACACCCTGACCNNNACGTATGCCA | 536 |
| TGCAGGACCAGAGAATTCGAATACACTGTCGTTNNNACGTATGCCA | 57 | TGCAGGACCAGAGAATTCGAATACACTTAAGGCNNNACGTATGCCA | 297 | TGCAGGACCAGAGAATTCGAATACAGTTGTAATNNNACGTATGCCA | 537 |
| TGCAGGACCAGAGAATTCGAATACATTCGAGGTNNNACGTATGCCA | 58 | TGCAGGACCAGAGAATTCGAATACACGAATCCANNNACGTATGCCA | 298 | TGCAGGACCAGAGAATTCGAATACAAAAAGACTNNNACGTATGCCA | 538 |
| TGCAGGACCAGAGAATTCGAATACACCTCCACGNNNACGTATGCCA | 59 | TGCAGGACCAGAGAATTCGAATACACAACTAATNNNACGTATGCCA | 299 | TGCAGGACCAGAGAATTCGAATACATCCTAGCTNNNACGTATGCCA | 539 |
| TGCAGGACCAGAGAATTCGAATACAGAGACTAGNNNACGTATGCCA | 60 | TGCAGGACCAGAGAATTCGAATACATCACACCTNNNACGTATGCCA | 300 | TGCAGGACCAGAGAATTCGAATACAACCAAAGGNNNACGTATGCCA | 540 |
| TGCAGGACCAGAGAATTCGAATACATGAACTATNNNACGTATGCCA | 61 | TGCAGGACCAGAGAATTCGAATACAGACCGTCGNNNACGTATGCCA | 301 | TGCAGGACCAGAGAATTCGAATACAACGAGTTCNNNACGTATGCCA | 541 |
| TGCAGGACCAGAGAATTCGAATACAGTTGATTANNNACGTATGCCA | 62 | TGCAGGACCAGAGAATTCGAATACACTTTAAGANNNACGTATGCCA | 302 | TGCAGGACCAGAGAATTCGAATACACTATGGTGNNNACGTATGCCA | 542 |
| TGCAGGACCAGAGAATTCGAATACATCCACTCANNNACGTATGCCA | 63 | TGCAGGACCAGAGAATTCGAATACATGTGATTANNNACGTATGCCA | 303 | TGCAGGACCAGAGAATTCGAATACACCACCGTCNNNACGTATGCCA | 543 |
| TGCAGGACCAGAGAATTCGAATACAGTGACTGTNNNACGTATGCCA | 64 | TGCAGGACCAGAGAATTCGAATACAACCCAATGNNNACGTATGCCA | 304 | TGCAGGACCAGAGAATTCGAATACAGAATCGCTNNNACGTATGCCA | 544 |
| TGCAGGACCAGAGAATTCGAATACATTACGGCANNNACGTATGCCA | 65 | TGCAGGACCAGAGAATTCGAATACAACGTGTACNNNACGTATGCCA | 305 | TGCAGGACCAGAGAATTCGAATACAAGTGTTATNNNACGTATGCCA | 545 |
| TGCAGGACCAGAGAATTCGAATACACACCTCCGNNNACGTATGCCA | 66 | TGCAGGACCAGAGAATTCGAATACAATGAAATGNNNACGTATGCCA | 306 | TGCAGGACCAGAGAATTCGAATACAACGCGTCGNNNACGTATGCCA | 546 |
| TGCAGGACCAGAGAATTCGAATACAAAGAAGAANNNACGTATGCCA | 67 | TGCAGGACCAGAGAATTCGAATACATCCTCGTANNNACGTATGCCA | 307 | TGCAGGACCAGAGAATTCGAATACACTCGTGTTNNNACGTATGCCA | 547 |
| TGCAGGACCAGAGAATTCGAATACAGAACCTGTNNNACGTATGCCA | 68 | TGCAGGACCAGAGAATTCGAATACAGTAACAGGNNNACGTATGCCA | 308 | TGCAGGACCAGAGAATTCGAATACATTGTAGATNNNACGTATGCCA | 548 |
| TGCAGGACCAGAGAATTCGAATACAGAATAACANNNCTAGCGTTAC | 69 | TGCAGGACCAGAGAATTCGAATACAACTCGGTANNNCTAGCGTTAC | 309 | TGCAGGACCAGAGAATTCGAATACAGCCGCAGTNNNCTAGCGTTAC | 549 |
| TGCAGGACCAGAGAATTCGAATACAGCCTCGTCNNNCTAGCGTTAC | 70 | TGCAGGACCAGAGAATTCGAATACAACGCTTAGNNNCTAGCGTTAC | 310 | TGCAGGACCAGAGAATTCGAATACAAGTGACGANNNCTAGCGTTAC | 550 |
| TGCAGGACCAGAGAATTCGAATACACCCGCACTNNNCTAGCGTTAC | 71 | TGCAGGACCAGAGAATTCGAATACATCAAGCTGNNNCTAGCGTTAC | 311 | TGCAGGACCAGAGAATTCGAATACAATACCTCCNNNCTAGCGTTAC | 551 |
| TGCAGGACCAGAGAATTCGAATACACCACGATANNNCTAGCGTTAC | 72 | TGCAGGACCAGAGAATTCGAATACATAGCTAATNNNCTAGCGTTAC | 312 | TGCAGGACCAGAGAATTCGAATACACTTTTTGANNNCTAGCGTTAC | 552 |
| TGCAGGACCAGAGAATTCGAATACACGGTACATNNNCTAGCGTTAC | 73 | TGCAGGACCAGAGAATTCGAATACACGGCATTANNNCTAGCGTTAC | 313 | TGCAGGACCAGAGAATTCGAATACAATATCATGNNNCTAGCGTTAC | 553 |
| TGCAGGACCAGAGAATTCGAATACACCATATCCNNNCTAGCGTTAC | 74 | TGCAGGACCAGAGAATTCGAATACAAATGATGANNNCTAGCGTTAC | 314 | TGCAGGACCAGAGAATTCGAATACATACATATGNNNCTAGCGTTAC | 554 |

FIG. 12C

| Pool-1 | SEQ ID NO: | Pool-2 | SEQ ID NO: | Pool-3 | SEQ ID NO: |
|---|---|---|---|---|---|
| TGCAGGACCAGAGAATTCGAATACACATACGGTNNNCTAGCGTTAC | 75 | TGCAGGACCAGAGAATTCGAATACATCGCGATANNNCTAGCGTTAC | 315 | TGCAGGACCAGAGAATTCGAATACAACTTTTGTNNNCTAGCGTTAC | 555 |
| TGCAGGACCAGAGAATTCGAATACAAATAGCTTNNNCTAGCGTTAC | 76 | TGCAGGACCAGAGAATTCGAATACACACAGGTTNNNCTAGCGTTAC | 316 | TGCAGGACCAGAGAATTCGAATACATAATGTACNNNCTAGCGTTAC | 556 |
| TGCAGGACCAGAGAATTCGAATACACCAGGTATNNNCTAGCGTTAC | 77 | TGCAGGACCAGAGAATTCGAATACAACGGTGCCNNNCTAGCGTTAC | 317 | TGCAGGACCAGAGAATTCGAATACAAACGACAGNNNCTAGCGTTAC | 557 |
| TGCAGGACCAGAGAATTCGAATACACAACCTGANNNCTAGCGTTAC | 78 | TGCAGGACCAGAGAATTCGAATACAGTTACAGCNNNCTAGCGTTAC | 318 | TGCAGGACCAGAGAATTCGAATACAGCTCCTATNNNCTAGCGTTAC | 558 |
| TGCAGGACCAGAGAATTCGAATACATGATGGTCNNNCTAGCGTTAC | 79 | TGCAGGACCAGAGAATTCGAATACATGCGATGTNNNCTAGCGTTAC | 319 | TGCAGGACCAGAGAATTCGAATACACCGAAACTNNNCTAGCGTTAC | 559 |
| TGCAGGACCAGAGAATTCGAATACAGGAGCCGANNNCTAGCGTTAC | 80 | TGCAGGACCAGAGAATTCGAATACAATGGTGCTNNNCTAGCGTTAC | 320 | TGCAGGACCAGAGAATTCGAATACAGCTAGGAANNNCTAGCGTTAC | 560 |
| TGCAGGACCAGAGAATTCGAATACAATGCGGCCNNNCTAGCGTTAC | 81 | TGCAGGACCAGAGAATTCGAATACAACCCCAGGNNNCTAGCGTTAC | 321 | TGCAGGACCAGAGAATTCGAATACAGCTTCCGCNNNCTAGCGTTAC | 561 |
| TGCAGGACCAGAGAATTCGAATACATGCTGTAGNNNCTAGCGTTAC | 82 | TGCAGGACCAGAGAATTCGAATACAGCAGACGGNNNCTAGCGTTAC | 322 | TGCAGGACCAGAGAATTCGAATACAACAGCATCNNNCTAGCGTTAC | 562 |
| TGCAGGACCAGAGAATTCGAATACAGCATTGACNNNCTAGCGTTAC | 83 | TGCAGGACCAGAGAATTCGAATACACTGGCAGCNNNCTAGCGTTAC | 323 | TGCAGGACCAGAGAATTCGAATACAACGAGAGTNNNCTAGCGTTAC | 563 |
| TGCAGGACCAGAGAATTCGAATACATTTGTACTNNNCTAGCGTTAC | 84 | TGCAGGACCAGAGAATTCGAATACAAGAGAGTCNNNCTAGCGTTAC | 324 | TGCAGGACCAGAGAATTCGAATACAATCATATGNNNCTAGCGTTAC | 564 |
| TGCAGGACCAGAGAATTCGAATACACATATGGCNNNCTAGCGTTAC | 85 | TGCAGGACCAGAGAATTCGAATACACGTTTTATNNNCTAGCGTTAC | 325 | TGCAGGACCAGAGAATTCGAATACATGAGATTTNNNCTAGCGTTAC | 565 |
| TGCAGGACCAGAGAATTCGAATACAGCATGAAGNNNCTAGCGTTAC | 86 | TGCAGGACCAGAGAATTCGAATACAAGAGGTCANNNCTAGCGTTAC | 326 | TGCAGGACCAGAGAATTCGAATACAGCCGGCCGNNNCTAGCGTTAC | 566 |
| TGCAGGACCAGAGAATTCGAATACACAGGAAACNNNCTAGCGTTAC | 87 | TGCAGGACCAGAGAATTCGAATACATTCTCTCCNNNCTAGCGTTAC | 327 | TGCAGGACCAGAGAATTCGAATACAAGGCGCAGNNNCTAGCGTTAC | 567 |
| TGCAGGACCAGAGAATTCGAATACACCTAAGACNNNCTAGCGTTAC | 88 | TGCAGGACCAGAGAATTCGAATACACGTGTCTTNNNCTAGCGTTAC | 328 | TGCAGGACCAGAGAATTCGAATACAGTACACACNNNCTAGCGTTAC | 568 |
| TGCAGGACCAGAGAATTCGAATACAACCTAGGTNNNCTAGCGTTAC | 89 | TGCAGGACCAGAGAATTCGAATACACTCGCAANNNCTAGCGTTAC | 329 | TGCAGGACCAGAGAATTCGAATACAAGATTTCANNNCTAGCGTTAC | 569 |
| TGCAGGACCAGAGAATTCGAATACACCATTGTCNNNCTAGCGTTAC | 90 | TGCAGGACCAGAGAATTCGAATACATCTTATGTNNNCTAGCGTTAC | 330 | TGCAGGACCAGAGAATTCGAATACATGCATCTCNNNCTAGCGTTAC | 570 |
| TGCAGGACCAGAGAATTCGAATACATCGGTTTCNNNCTAGCGTTAC | 91 | TGCAGGACCAGAGAATTCGAATACATCGGCACGNNNCTAGCGTTAC | 331 | TGCAGGACCAGAGAATTCGAATACACTCAGAGTNNNCTAGCGTTAC | 571 |
| TGCAGGACCAGAGAATTCGAATACACACCTGTTNNNCTAGCGTTAC | 92 | TGCAGGACCAGAGAATTCGAATACACGTTTCTGNNNCTAGCGTTAC | 332 | TGCAGGACCAGAGAATTCGAATACAACTCTGTCNNNCTAGCGTTAC | 572 |
| TGCAGGACCAGAGAATTCGAATACAAGAGAGAGNNNCTAGCGTTAC | 93 | TGCAGGACCAGAGAATTCGAATACAATGTGAGGNNNCTAGCGTTAC | 333 | TGCAGGACCAGAGAATTCGAATACATTATCCGCNNNCTAGCGTTAC | 573 |
| TGCAGGACCAGAGAATTCGAATACAATGCCCGNNNCTAGCGTTAC | 94 | TGCAGGACCAGAGAATTCGAATACAAGAAACATNNNCTAGCGTTAC | 334 | TGCAGGACCAGAGAATTCGAATACAGCCCTTGCNNNCTAGCGTTAC | 574 |
| TGCAGGACCAGAGAATTCGAATACATAGCGTGTNNNCTAGCGTTAC | 95 | TGCAGGACCAGAGAATTCGAATACAGAGAGAAGNNNCTAGCGTTAC | 335 | TGCAGGACCAGAGAATTCGAATACAAACTTCTTNNNCTAGCGTTAC | 575 |
| TGCAGGACCAGAGAATTCGAATACAGAAGACACNNNCTAGCGTTAC | 96 | TGCAGGACCAGAGAATTCGAATACACTTCAGGANNNCTAGCGTTAC | 336 | TGCAGGACCAGAGAATTCGAATACATTGTAGGCNNNCTAGCGTTAC | 576 |
| TGCAGGACCAGAGAATTCGAATACATCATTTGTNNNCTAGCGTTAC | 97 | TGCAGGACCAGAGAATTCGAATACATCCCTCGGNNNCTAGCGTTAC | 337 | TGCAGGACCAGAGAATTCGAATACATGACCCAANNNCTAGCGTTAC | 577 |
| TGCAGGACCAGAGAATTCGAATACATCGAACACNNNCTAGCGTTAC | 98 | TGCAGGACCAGAGAATTCGAATACACCTTCCTTNNNCTAGCGTTAC | 338 | TGCAGGACCAGAGAATTCGAATACACCTCTGTANNNCTAGCGTTAC | 578 |
| TGCAGGACCAGAGAATTCGAATACAAGCTTACGNNNCTAGCGTTAC | 99 | TGCAGGACCAGAGAATTCGAATACATAGTTATGNNNCTAGCGTTAC | 339 | TGCAGGACCAGAGAATTCGAATACAAGCCACTANNNCTAGCGTTAC | 579 |
| TGCAGGACCAGAGAATTCGAATACACTCGGTTTNNNCTAGCGTTAC | 100 | TGCAGGACCAGAGAATTCGAATACAGCATAGAGNNNCTAGCGTTAC | 340 | TGCAGGACCAGAGAATTCGAATACATGTATGATNNNCTAGCGTTAC | 580 |
| TGCAGGACCAGAGAATTCGAATACAAATCGTTANNNCTAGCGTTAC | 101 | TGCAGGACCAGAGAATTCGAATACATAGCTCCTNNNCTAGCGTTAC | 341 | TGCAGGACCAGAGAATTCGAATACACAGGTCGCNNNCTAGCGTTAC | 581 |
| TGCAGGACCAGAGAATTCGAATACATAACAGTTNNNCTAGCGTTAC | 102 | TGCAGGACCAGAGAATTCGAATACAACCACGTANNNCTAGCGTTAC | 342 | TGCAGGACCAGAGAATTCGAATACATTTTTTTNNNCTAGCGTTAC | 582 |
| TGCAGGACCAGAGAATTCGAATACAATCCTGTCNNNCTAGCGTTAC | 103 | TGCAGGACCAGAGAATTCGAATACACATCGTCTNNNCTAGCGTTAC | 343 | TGCAGGACCAGAGAATTCGAATACATTTGCGGANNNCTAGCGTTAC | 583 |
| TGCAGGACCAGAGAATTCGAATACAGTAATGTTNNNCTAGCGTTAC | 104 | TGCAGGACCAGAGAATTCGAATACAAGAGATTANNNCTAGCGTTAC | 344 | TGCAGGACCAGAGAATTCGAATACAAGCCTGTANNNCTAGCGTTAC | 584 |
| TGCAGGACCAGAGAATTCGAATACATTGCGCGGNNNCTAGCGTTAC | 105 | TGCAGGACCAGAGAATTCGAATACAATCAAAGANNNCTAGCGTTAC | 345 | TGCAGGACCAGAGAATTCGAATACAGCGGCACTNNNCTAGCGTTAC | 585 |
| TGCAGGACCAGAGAATTCGAATACAGTCAGGAANNNCTAGCGTTAC | 106 | TGCAGGACCAGAGAATTCGAATACAGGAGTACANNNCTAGCGTTAC | 346 | TGCAGGACCAGAGAATTCGAATACATGTTGAGCNNNCTAGCGTTAC | 586 |
| TGCAGGACCAGAGAATTCGAATACAGTTAAAAGNNNCTAGCGTTAC | 107 | TGCAGGACCAGAGAATTCGAATACAATAGCAGGNNNCTAGCGTTAC | 347 | TGCAGGACCAGAGAATTCGAATACAAAAAGTTGNNNCTAGCGTTAC | 587 |

FIG. 12D

| Pool-1 | SEQ ID NO: | Pool-2 | SEQ ID NO: | Pool-3 | SEQ ID NO: |
|---|---|---|---|---|---|
| TGCAGGACCAGAGAATTCGAATA CATGTCATAANNNCTAGCGTTAC | 108 | TGCAGGACCAGAGAATTCGAATA CATCTAATTCNNNCTAGCGTTAC | 348 | TGCAGGACCAGAGAATTCGAATA CACGGTGCCANNNCTAGCGTTAC | 588 |
| TGCAGGACCAGAGAATTCGAATA CAACTTGAATNNNCTAGCGTTAC | 109 | TGCAGGACCAGAGAATTCGAATA CAGTTCCCGCNNNCTAGCGTTAC | 349 | TGCAGGACCAGAGAATTCGAATA CACAGCGGTCNNNCTAGCGTTAC | 589 |
| TGCAGGACCAGAGAATTCGAATA CATGTGGCATNNNCTAGCGTTAC | 110 | TGCAGGACCAGAGAATTCGAATA CATAGATTGNNNCTAGCGTTAC | 350 | TGCAGGACCAGAGAATTCGAATA CAAGCTAACCNNNCTAGCGTTAC | 590 |
| TGCAGGACCAGAGAATTCGAATA CATCTACACCNNNCTAGCGTTAC | 111 | TGCAGGACCAGAGAATTCGAATA CACGGCAGAGNNNCTAGCGTTAC | 351 | TGCAGGACCAGAGAATTCGAATA CAACGGCGTCNNNCTAGCGTTAC | 591 |
| TGCAGGACCAGAGAATTCGAATA CATCATGCCTNNNCTAGCGTTAC | 112 | TGCAGGACCAGAGAATTCGAATA CACCTCGTGCNNNCTAGCGTTAC | 352 | TGCAGGACCAGAGAATTCGAATA CATAGTTCAANNNCTAGCGTTAC | 592 |
| TGCAGGACCAGAGAATTCGAATA CATCTAGCCTNNNCTAGCGTTAC | 113 | TGCAGGACCAGAGAATTCGAATA CACCCTTGATNNNCTAGCGTTAC | 353 | TGCAGGACCAGAGAATTCGAATA CAATGTAGCCNNNCTAGCGTTAC | 593 |
| TGCAGGACCAGAGAATTCGAATA CAATAAAGCANNNCTAGCGTTAC | 114 | TGCAGGACCAGAGAATTCGAATA CACGTCACGNNNCTAGCGTTAC | 354 | TGCAGGACCAGAGAATTCGAATA CAAGAAGCACNNNCTAGCGTTAC | 594 |
| TGCAGGACCAGAGAATTCGAATA CATGCATAATNNNCTAGCGTTAC | 115 | TGCAGGACCAGAGAATTCGAATA CAGTTTGGCANNNCTAGCGTTAC | 355 | TGCAGGACCAGAGAATTCGAATA CAGAAGCGCGNNNCTAGCGTTAC | 595 |
| TGCAGGACCAGAGAATTCGAATA CACATGACGTNNNCTAGCGTTAC | 116 | TGCAGGACCAGAGAATTCGAATA CATGCTCTGTNNNCTAGCGTTAC | 356 | TGCAGGACCAGAGAATTCGAATA CACGGTATACNNNCTAGCGTTAC | 596 |
| TGCAGGACCAGAGAATTCGAATA CACTTATCATNNNCTAGCGTTAC | 117 | TGCAGGACCAGAGAATTCGAATA CATCAGGTATANNNCTAGCGTTAC | 357 | TGCAGGACCAGAGAATTCGAATA CATAACATACNNNCTAGCGTTAC | 597 |
| TGCAGGACCAGAGAATTCGAATA CACGGCCTGANNNCTAGCGTTAC | 118 | TGCAGGACCAGAGAATTCGAATA CACCCAAGTANNNCTAGCGTTAC | 358 | TGCAGGACCAGAGAATTCGAATA CACTGCTATCNNNCTAGCGTTAC | 598 |
| TGCAGGACCAGAGAATTCGAATA CACGTCAATGNNNCTAGCGTTAC | 119 | TGCAGGACCAGAGAATTCGAATA CAAAGCTAAANNNCTAGCGTTAC | 359 | TGCAGGACCAGAGAATTCGAATA CACGGCAACCNNNCTAGCGTTAC | 599 |
| TGCAGGACCAGAGAATTCGAATA CACTTATACTNNNCTAGCGTTAC | 120 | TGCAGGACCAGAGAATTCGAATA CAAGATCCACNNNCTAGCGTTAC | 360 | TGCAGGACCAGAGAATTCGAATA CACAAAAACANNNCTAGCGTTAC | 600 |
| TGCAGGACCAGAGAATTCGAATA CAGGAGGTATNNNCTAGCGTTAC | 121 | TGCAGGACCAGAGAATTCGAATA CAGCATCGGCNNNCTAGCGTTAC | 361 | TGCAGGACCAGAGAATTCGAATA CACGTTAGCANNNCTAGCGTTAC | 601 |
| TGCAGGACCAGAGAATTCGAATA CAATTGTTCTNNNCTAGCGTTAC | 122 | TGCAGGACCAGAGAATTCGAATA CACTCTGGAANNNCTAGCGTTAC | 362 | TGCAGGACCAGAGAATTCGAATA CACCCTAATCNNNCTAGCGTTAC | 602 |
| TGCAGGACCAGAGAATTCGAATA CAAACTCCAGNNNCTAGCGTTAC | 123 | TGCAGGACCAGAGAATTCGAATA CAAGCTCTGACNNNCTAGCGTTAC | 363 | TGCAGGACCAGAGAATTCGAATA CATGTGGCCGNNNCTAGCGTTAC | 603 |
| TGCAGGACCAGAGAATTCGAATA CACGAGGTCCNNNCTAGCGTTAC | 124 | TGCAGGACCAGAGAATTCGAATA CAGAGGCCGANNNCTAGCGTTAC | 364 | TGCAGGACCAGAGAATTCGAATA CATCTAGAGCNNNCTAGCGTTAC | 604 |
| TGCAGGACCAGAGAATTCGAATA CACGCGACCANNNCTAGCGTTAC | 125 | TGCAGGACCAGAGAATTCGAATA CATGGTGGAANNNCTAGCGTTAC | 365 | TGCAGGACCAGAGAATTCGAATA CATACGCATGNNNCTAGCGTTAC | 605 |
| TGCAGGACCAGAGAATTCGAATA CATGCCGCCTNNNCTAGCGTTAC | 126 | TGCAGGACCAGAGAATTCGAATA CACGGTGTTANNNCTAGCGTTAC | 366 | TGCAGGACCAGAGAATTCGAATA CATTGCCCGNNNCTAGCGTTAC | 606 |
| TGCAGGACCAGAGAATTCGAATA CAGTTACGACNNNCTAGCGTTAC | 127 | TGCAGGACCAGAGAATTCGAATA CATCCGCGANNNCTAGCGTTAC | 367 | TGCAGGACCAGAGAATTCGAATA CATGGTTCCTNNNCTAGCGTTAC | 607 |
| TGCAGGACCAGAGAATTCGAATA CATTATCATCNNNCTAGCGTTAC | 128 | TGCAGGACCAGAGAATTCGAATA CAGCTGTGTANNNCTAGCGTTAC | 368 | TGCAGGACCAGAGAATTCGAATA CAAACGGTGANNNCTAGCGTTAC | 608 |
| TGCAGGACCAGAGAATTCGAATA CACCTTCTCTNNNGATCGACATG | 129 | TGCAGGACCAGAGAATTCGAATA CAACGTGCGCNNNGATCGACATG | 369 | TGCAGGACCAGAGAATTCGAATA CAGGCTATACNNNGATCGACATG | 609 |
| TGCAGGACCAGAGAATTCGAATA CAAACAGGTGNNNGATCGACATG | 130 | TGCAGGACCAGAGAATTCGAATA CAATCAGCCANNNGATCGACATG | 370 | TGCAGGACCAGAGAATTCGAATA CAATTGGTTANNNGATCGACATG | 610 |
| TGCAGGACCAGAGAATTCGAATA CAACTTGTCCNNNGATCGACATG | 131 | TGCAGGACCAGAGAATTCGAATA CAGATACTTANNNGATCGACATG | 371 | TGCAGGACCAGAGAATTCGAATA CACAGGATGANNNGATCGACATG | 611 |
| TGCAGGACCAGAGAATTCGAATA CATTGGTAATNNNGATCGACATG | 132 | TGCAGGACCAGAGAATTCGAATA CAATTCGCCNNNGATCGACATG | 372 | TGCAGGACCAGAGAATTCGAATA CACGTTATCCNNNGATCGACATG | 612 |
| TGCAGGACCAGAGAATTCGAATA CAGGACTCGCNNNGATCGACATG | 133 | TGCAGGACCAGAGAATTCGAATA CACTTAAAGTNNNGATCGACATG | 373 | TGCAGGACCAGAGAATTCGAATA CAGTTCAATANNNGATCGACATG | 613 |
| TGCAGGACCAGAGAATTCGAATA CATGCGTCAANNNGATCGACATG | 134 | TGCAGGACCAGAGAATTCGAATA CATATGCCCTNNNGATCGACATG | 374 | TGCAGGACCAGAGAATTCGAATA CACAAAATCTNNNGATCGACATG | 614 |
| TGCAGGACCAGAGAATTCGAATA CACAGAATAANNNGATCGACATG | 135 | TGCAGGACCAGAGAATTCGAATA CAACTTGGCANNNGATCGACATG | 375 | TGCAGGACCAGAGAATTCGAATA CACTGCAAACNNNGATCGACATG | 615 |
| TGCAGGACCAGAGAATTCGAATA CATCCCAGGCNNNGATCGACATG | 136 | TGCAGGACCAGAGAATTCGAATA CAAGGACCANNNGATCGACATG | 376 | TGCAGGACCAGAGAATTCGAATA CAGGTGCCCANNNGATCGACATG | 616 |
| TGCAGGACCAGAGAATTCGAATA CAATTCTTGNNNGATCGACATG | 137 | TGCAGGACCAGAGAATTCGAATA CATGAGCGAANNNGATCGACATG | 377 | TGCAGGACCAGAGAATTCGAATA CACGATAACCNNNGATCGACATG | 617 |
| TGCAGGACCAGAGAATTCGAATA CAACTTGTAANNNGATCGACATG | 138 | TGCAGGACCAGAGAATTCGAATA CATGCTGTGANNNGATCGACATG | 378 | TGCAGGACCAGAGAATTCGAATA CATTATGACANNNGATCGACATG | 618 |
| TGCAGGACCAGAGAATTCGAATA CACACGGTGCNNNGATCGACATG | 139 | TGCAGGACCAGAGAATTCGAATA CAGGTTCGTANNNGATCGACATG | 379 | TGCAGGACCAGAGAATTCGAATA CAACCTTCACNNNGATCGACATG | 619 |
| TGCAGGACCAGAGAATTCGAATA CAAACTCGGTNNNGATCGACATG | 140 | TGCAGGACCAGAGAATTCGAATA CAACAAACAANNNGATCGACATG | 380 | TGCAGGACCAGAGAATTCGAATA CATCTTCTCCNNNGATCGACATG | 620 |

FIG. 12E

| Pool-1 | SEQ ID NO: | Pool-2 | SEQ ID NO: | Pool-3 | SEQ ID NO: |
|---|---|---|---|---|---|
| TGCAGGACCAGAGAATTCGAATACAGCCTATTCNNNGATCGACATG | 141 | TGCAGGACCAGAGAATTCGAATACAAGCTAGAGNNNGATCGACATG | 381 | TGCAGGACCAGAGAATTCGAATACACCCCAGCTNNNGATCGACATG | 621 |
| TGCAGGACCAGAGAATTCGAATACACCGCTAAANNNGATCGACATG | 142 | TGCAGGACCAGAGAATTCGAATACATTAAATATNNNGATCGACATG | 382 | TGCAGGACCAGAGAATTCGAATACACTAGTGTGNNNGATCGACATG | 622 |
| TGCAGGACCAGAGAATTCGAATACAGTGAGATGNNNGATCGACATG | 143 | TGCAGGACCAGAGAATTCGAATACAAGGAGTCANNNGATCGACATG | 383 | TGCAGGACCAGAGAATTCGAATACAGTTCTAAANNNGATCGACATG | 623 |
| TGCAGGACCAGAGAATTCGAATACATCTCTCAGNNNGATCGACATG | 144 | TGCAGGACCAGAGAATTCGAATACACGCACAGCNNNGATCGACATG | 384 | TGCAGGACCAGAGAATTCGAATACAGCGTTTTCNNNGATCGACATG | 624 |
| TGCAGGACCAGAGAATTCGAATACATCTCTAGCNNNGATCGACATG | 145 | TGCAGGACCAGAGAATTCGAATACAGCGGACAGNNNGATCGACATG | 385 | TGCAGGACCAGAGAATTCGAATACAGTCTGCCCNNNGATCGACATG | 625 |
| TGCAGGACCAGAGAATTCGAATACACAAGCGCCNNNGATCGACATG | 146 | TGCAGGACCAGAGAATTCGAATACACGCTCGTCNNNGATCGACATG | 386 | TGCAGGACCAGAGAATTCGAATACAACAGAAATNNNGATCGACATG | 626 |
| TGCAGGACCAGAGAATTCGAATACAGGCAGTAANNNGATCGACATG | 147 | TGCAGGACCAGAGAATTCGAATACATCTGATGGNNNGATCGACATG | 387 | TGCAGGACCAGAGAATTCGAATACATTGCTATTNNNGATCGACATG | 627 |
| TGCAGGACCAGAGAATTCGAATACATTGGCTGANNNGATCGACATG | 148 | TGCAGGACCAGAGAATTCGAATACAGGCTAGAANNNGATCGACATG | 388 | TGCAGGACCAGAGAATTCGAATACACCCTGTGCNNNGATCGACATG | 628 |
| TGCAGGACCAGAGAATTCGAATACAACAGCGAANNNGATCGACATG | 149 | TGCAGGACCAGAGAATTCGAATACAATGAGGCANNNGATCGACATG | 389 | TGCAGGACCAGAGAATTCGAATACAGCAGTCCGNNNGATCGACATG | 629 |
| TGCAGGACCAGAGAATTCGAATACAAAGTTTCANNNGATCGACATG | 150 | TGCAGGACCAGAGAATTCGAATACACACCCGTCNNNGATCGACATG | 390 | TGCAGGACCAGAGAATTCGAATACAGTAACCCANNNGATCGACATG | 630 |
| TGCAGGACCAGAGAATTCGAATACACGCTCTATNNNGATCGACATG | 151 | TGCAGGACCAGAGAATTCGAATACATCATCGGANNNGATCGACATG | 391 | TGCAGGACCAGAGAATTCGAATACAACATTGTANNNGATCGACATG | 631 |
| TGCAGGACCAGAGAATTCGAATACATAGGAGTGNNNGATCGACATG | 152 | TGCAGGACCAGAGAATTCGAATACAGGCAAGCGNNNGATCGACATG | 392 | TGCAGGACCAGAGAATTCGAATACAAAACCGTCNNNGATCGACATG | 632 |
| TGCAGGACCAGAGAATTCGAATACATCAGCACANNNGATCGACATG | 153 | TGCAGGACCAGAGAATTCGAATACACAGTCGATNNNGATCGACATG | 393 | TGCAGGACCAGAGAATTCGAATACAATTCTGCCNNNGATCGACATG | 633 |
| TGCAGGACCAGAGAATTCGAATACACGAACTACNNNGATCGACATG | 154 | TGCAGGACCAGAGAATTCGAATACATGCTACTCNNNGATCGACATG | 394 | TGCAGGACCAGAGAATTCGAATACATCTAGGCANNNGATCGACATG | 634 |
| TGCAGGACCAGAGAATTCGAATACATACTAAACNNNGATCGACATG | 155 | TGCAGGACCAGAGAATTCGAATACATCCATACANNNGATCGACATG | 395 | TGCAGGACCAGAGAATTCGAATACAGGTCTACANNNGATCGACATG | 635 |
| TGCAGGACCAGAGAATTCGAATACAGGTACAAGNNNGATCGACATG | 156 | TGCAGGACCAGAGAATTCGAATACAACCGCGACNNNGATCGACATG | 396 | TGCAGGACCAGAGAATTCGAATACAGGTGAGCGNNNGATCGACATG | 636 |
| TGCAGGACCAGAGAATTCGAATACAACAGGCTTNNNGATCGACATG | 157 | TGCAGGACCAGAGAATTCGAATACAGGCAAAGTNNNGATCGACATG | 397 | TGCAGGACCAGAGAATTCGAATACATGTCTTTANNNGATCGACATG | 637 |
| TGCAGGACCAGAGAATTCGAATACAGAAACCCTNNNGATCGACATG | 158 | TGCAGGACCAGAGAATTCGAATACAGGATCCCGNNNGATCGACATG | 398 | TGCAGGACCAGAGAATTCGAATACATGGCTTGANNNGATCGACATG | 638 |
| TGCAGGACCAGAGAATTCGAATACATCCGCATTNNNGATCGACATG | 159 | TGCAGGACCAGAGAATTCGAATACACCTCTCTTNNNGATCGACATG | 399 | TGCAGGACCAGAGAATTCGAATACAATTACGCGNNNGATCGACATG | 639 |
| TGCAGGACCAGAGAATTCGAATACACAATCTGGNNNGATCGACATG | 160 | TGCAGGACCAGAGAATTCGAATACATCGTCGCCNNNGATCGACATG | 400 | TGCAGGACCAGAGAATTCGAATACATGGCTCTTNNNGATCGACATG | 640 |
| TGCAGGACCAGAGAATTCGAATACAACCTTACCNNNGATCGACATG | 161 | TGCAGGACCAGAGAATTCGAATACACCTATGTCNNNGATCGACATG | 401 | TGCAGGACCAGAGAATTCGAATACACACTCACTNNNGATCGACATG | 641 |
| TGCAGGACCAGAGAATTCGAATACAGCGGTCTGNNNGATCGACATG | 162 | TGCAGGACCAGAGAATTCGAATACAGGATGCTTNNNGATCGACATG | 402 | TGCAGGACCAGAGAATTCGAATACACTGCAGGCNNNGATCGACATG | 642 |
| TGCAGGACCAGAGAATTCGAATACAAATCACGCNNNGATCGACATG | 163 | TGCAGGACCAGAGAATTCGAATACAATTGAGAANNNGATCGACATG | 403 | TGCAGGACCAGAGAATTCGAATACACCCAATCTNNNGATCGACATG | 643 |
| TGCAGGACCAGAGAATTCGAATACAAATAGTAGNNNGATCGACATG | 164 | TGCAGGACCAGAGAATTCGAATACAGTGTTGTGNNNGATCGACATG | 404 | TGCAGGACCAGAGAATTCGAATACAACGTAACCNNNGATCGACATG | 644 |
| TGCAGGACCAGAGAATTCGAATACAGGCATCTANNNGATCGACATG | 165 | TGCAGGACCAGAGAATTCGAATACAAAGCAATAGNNNGATCGACATG | 405 | TGCAGGACCAGAGAATTCGAATACAACCGTCCCNNNGATCGACATG | 645 |
| TGCAGGACCAGAGAATTCGAATACAACCGCCTGNNNGATCGACATG | 166 | TGCAGGACCAGAGAATTCGAATACATTAGCGCANNNGATCGACATG | 406 | TGCAGGACCAGAGAATTCGAATACATTCGCGAANNNGATCGACATG | 646 |
| TGCAGGACCAGAGAATTCGAATACAGACCCGGTNNNGATCGACATG | 167 | TGCAGGACCAGAGAATTCGAATACAAACGGATGNNNGATCGACATG | 407 | TGCAGGACCAGAGAATTCGAATACACGCACAATNNNGATCGACATG | 647 |
| TGCAGGACCAGAGAATTCGAATACACGGTAAAGNNNGATCGACATG | 168 | TGCAGGACCAGAGAATTCGAATACAGCATGGAANNNGATCGACATG | 408 | TGCAGGACCAGAGAATTCGAATACACAATCTCCNNNGATCGACATG | 648 |
| TGCAGGACCAGAGAATTCGAATACAAGGATGCANNNGATCGACATG | 169 | TGCAGGACCAGAGAATTCGAATACATCTCTATANNNGATCGACATG | 409 | TGCAGGACCAGAGAATTCGAATACATCAGAGTCNNNGATCGACATG | 649 |
| TGCAGGACCAGAGAATTCGAATACATTCTGGAGNNNGATCGACATG | 170 | TGCAGGACCAGAGAATTCGAATACACTGCGCCTNNNGATCGACATG | 410 | TGCAGGACCAGAGAATTCGAATACAAATCGTGCNNNGATCGACATG | 650 |
| TGCAGGACCAGAGAATTCGAATACAGCTCAAACNNNGATCGACATG | 171 | TGCAGGACCAGAGAATTCGAATACAGATTCGCANNNGATCGACATG | 411 | TGCAGGACCAGAGAATTCGAATACACTAGCATGNNNGATCGACATG | 651 |
| TGCAGGACCAGAGAATTCGAATACATAAGTTACNNNGATCGACATG | 172 | TGCAGGACCAGAGAATTCGAATACAATCTATCTNNNGATCGACATG | 412 | TGCAGGACCAGAGAATTCGAATACAGATTAACTNNNGATCGACATG | 652 |
| TGCAGGACCAGAGAATTCGAATACACAACCCTTNNNGATCGACATG | 173 | TGCAGGACCAGAGAATTCGAATACAGTCACCCCNNNGATCGACATG | 413 | TGCAGGACCAGAGAATTCGAATACAGGCTACGCNNNGATCGACATG | 653 |

FIG. 12F

| Pool-1 | SEQ ID NO: | Pool-2 | SEQ ID NO: | Pool-3 | SEQ ID NO: |
|---|---|---|---|---|---|
| TGCAGGACCAGAGAATTCGAATACACCTTCCGGNNNGATCGACATG | 174 | TGCAGGACCAGAGAATTCGAATACACGTTGTGANNNGATCGACATG | 414 | TGCAGGACCAGAGAATTCGAATACAATACGAGGNNNGATCGACATG | 654 |
| TGCAGGACCAGAGAATTCGAATACAGTGAGAGTNNNGATCGACATG | 175 | TGCAGGACCAGAGAATTCGAATACAGCTCTGCCNNNGATCGACATG | 415 | TGCAGGACCAGAGAATTCGAATACAAAATGTCTNNNGATCGACATG | 655 |
| TGCAGGACCAGAGAATTCGAATACAGCGTCCAGNNNGATCGACATG | 176 | TGCAGGACCAGAGAATTCGAATACACATCGATGNNNGATCGACATG | 416 | TGCAGGACCAGAGAATTCGAATACAGCCCATCGNNNGATCGACATG | 656 |
| TGCAGGACCAGAGAATTCGAATACATTTATTCGNNNGATCGACATG | 177 | TGCAGGACCAGAGAATTCGAATACAAGTCGCCGNNNGATCGACATG | 417 | TGCAGGACCAGAGAATTCGAATACACTCCCGTGNNNGATCGACATG | 657 |
| TGCAGGACCAGAGAATTCGAATACAGTAATAAGNNNGATCGACATG | 178 | TGCAGGACCAGAGAATTCGAATACAGATAGCGANNNGATCGACATG | 418 | TGCAGGACCAGAGAATTCGAATACAGATAAGGCNNNGATCGACATG | 658 |
| TGCAGGACCAGAGAATTCGAATACATACAAGCCNNNGATCGACATG | 179 | TGCAGGACCAGAGAATTCGAATACATCTTTGGCNNNGATCGACATG | 419 | TGCAGGACCAGAGAATTCGAATACAGCACATCANNNGATCGACATG | 659 |
| TGCAGGACCAGAGAATTCGAATACAAAGCCGAANNNGATCGACATG | 180 | TGCAGGACCAGAGAATTCGAATACATCTCATCGNNNGATCGACATG | 420 | TGCAGGACCAGAGAATTCGAATACATCCTATGCNNNGATCGACATG | 660 |
| TGCAGGACCAGAGAATTCGAATACAATACTTTCNNNGATCGACATG | 181 | TGCAGGACCAGAGAATTCGAATACATGAGCGCCNNNGATCGACATG | 421 | TGCAGGACCAGAGAATTCGAATACACGCATCCNNNGATCGACATG | 661 |
| TGCAGGACCAGAGAATTCGAATACACTGGATCANNNGATCGACATG | 182 | TGCAGGACCAGAGAATTCGAATACAAGTCTCGANNNGATCGACATG | 422 | TGCAGGACCAGAGAATTCGAATACAACCGGTCGNNNGATCGACATG | 662 |
| TGCAGGACCAGAGAATTCGAATACAAACGCCTANNNGATCGACATG | 183 | TGCAGGACCAGAGAATTCGAATACAAAGGTATANNNGATCGACATG | 423 | TGCAGGACCAGAGAATTCGAATACACACGATGTNNNGATCGACATG | 663 |
| TGCAGGACCAGAGAATTCGAATACAGTCGAGAANNNGATCGACATG | 184 | TGCAGGACCAGAGAATTCGAATACAGGTGTCGCNNNGATCGACATG | 424 | TGCAGGACCAGAGAATTCGAATACAAACTCGCANNNGATCGACATG | 664 |
| TGCAGGACCAGAGAATTCGAATACATAATTCTCNNNGATCGACATG | 185 | TGCAGGACCAGAGAATTCGAATACATCACATCCNNNGATCGACATG | 425 | TGCAGGACCAGAGAATTCGAATACACCCCTTCCNNNGATCGACATG | 665 |
| TGCAGGACCAGAGAATTCGAATACATAACCCTCNNNGATCGACATG | 186 | TGCAGGACCAGAGAATTCGAATACAGCATACACNNNGATCGACATG | 426 | TGCAGGACCAGAGAATTCGAATACATCTTCGTGNNNGATCGACATG | 666 |
| TGCAGGACCAGAGAATTCGAATACAGCGCTTGGNNNGATCGACATG | 187 | TGCAGGACCAGAGAATTCGAATACATCCAACAGNNNGATCGACATG | 427 | TGCAGGACCAGAGAATTCGAATACATATTTAAANNNGATCGACATG | 667 |
| TGCAGGACCAGAGAATTCGAATACACGGACACCNNNGATCGACATG | 188 | TGCAGGACCAGAGAATTCGAATACATCTGCCTANNNGATCGACATG | 428 | TGCAGGACCAGAGAATTCGAATACATTAATGCANNNGATCGACATG | 668 |
| TGCAGGACCAGAGAATTCGAATACATGGAAGTGNNNTGCATCAGGT | 189 | TGCAGGACCAGAGAATTCGAATACACACACCGGNNNTGCATCAGGT | 429 | TGCAGGACCAGAGAATTCGAATACACTTTGGTCNNNTGCATCAGGT | 669 |
| TGCAGGACCAGAGAATTCGAATACAAAGTCTATNNNTGCATCAGGT | 190 | TGCAGGACCAGAGAATTCGAATACAGACCTCCCNNNTGCATCAGGT | 430 | TGCAGGACCAGAGAATTCGAATACATACGAAGGNNNTGCATCAGGT | 670 |
| TGCAGGACCAGAGAATTCGAATACAATGATAGNNNTGCATCAGGT | 191 | TGCAGGACCAGAGAATTCGAATACATGGCAATCNNNTGCATCAGGT | 431 | TGCAGGACCAGAGAATTCGAATACAAGTCACTGNNNTGCATCAGGT | 671 |
| TGCAGGACCAGAGAATTCGAATACATTCTCCTCNNNTGCATCAGGT | 192 | TGCAGGACCAGAGAATTCGAATACATCTCCGGCNNNTGCATCAGGT | 432 | TGCAGGACCAGAGAATTCGAATACAGTTTATCTNNNTGCATCAGGT | 672 |
| TGCAGGACCAGAGAATTCGAATACACCAGCCCTNNNTGCATCAGGT | 193 | TGCAGGACCAGAGAATTCGAATACACCAGCGTGNNNTGCATCAGGT | 433 | TGCAGGACCAGAGAATTCGAATACATTTCGAAANNNTGCATCAGGT | 673 |
| TGCAGGACCAGAGAATTCGAATACAAACAAAACNNNTGCATCAGGT | 194 | TGCAGGACCAGAGAATTCGAATACAAAATATAANNNTGCATCAGGT | 434 | TGCAGGACCAGAGAATTCGAATACACAGATCACNNNTGCATCAGGT | 674 |
| TGCAGGACCAGAGAATTCGAATACACGCTCACCNNNTGCATCAGGT | 195 | TGCAGGACCAGAGAATTCGAATACAGCAATTTANNNTGCATCAGGT | 435 | TGCAGGACCAGAGAATTCGAATACATTGGAAGGNNNTGCATCAGGT | 675 |
| TGCAGGACCAGAGAATTCGAATACATGGTGATCNNNTGCATCAGGT | 196 | TGCAGGACCAGAGAATTCGAATACAACTCAGTGNNNTGCATCAGGT | 436 | TGCAGGACCAGAGAATTCGAATACAGTGCGGCTNNNTGCATCAGGT | 676 |
| TGCAGGACCAGAGAATTCGAATACAGTTGCTAGNNNTGCATCAGGT | 197 | TGCAGGACCAGAGAATTCGAATACAAGAGGCATNNNTGCATCAGGT | 437 | TGCAGGACCAGAGAATTCGAATACATGAAGGCANNNTGCATCAGGT | 677 |
| TGCAGGACCAGAGAATTCGAATACATCACCCTANNNTGCATCAGGT | 198 | TGCAGGACCAGAGAATTCGAATACATAGGCTTGNNNTGCATCAGGT | 438 | TGCAGGACCAGAGAATTCGAATACAAAAAGTACNNNTGCATCAGGT | 678 |
| TGCAGGACCAGAGAATTCGAATACAGACTCTGANNNTGCATCAGGT | 199 | TGCAGGACCAGAGAATTCGAATACACACACAGTNNNTGCATCAGGT | 439 | TGCAGGACCAGAGAATTCGAATACAGATGGAACNNNTGCATCAGGT | 679 |
| TGCAGGACCAGAGAATTCGAATACACGTATGACNNNTGCATCAGGT | 200 | TGCAGGACCAGAGAATTCGAATACATGATAGAANNNTGCATCAGGT | 440 | TGCAGGACCAGAGAATTCGAATACAGCCCTCGAGNNNTGCATCAGGT | 680 |
| TGCAGGACCAGAGAATTCGAATACATGCACCGNNNTGCATCAGGT | 201 | TGCAGGACCAGAGAATTCGAATACAGACACANNNTGCATCAGGT | 441 | TGCAGGACCAGAGAATTCGAATACAAAATAAATNNNTGCATCAGGT | 681 |
| TGCAGGACCAGAGAATTCGAATACAACTGATGCNNNTGCATCAGGT | 202 | TGCAGGACCAGAGAATTCGAATACACTGCCTCGNNNTGCATCAGGT | 442 | TGCAGGACCAGAGAATTCGAATACATTCCCCCNNNTGCATCAGGT | 682 |
| TGCAGGACCAGAGAATTCGAATACATACGTTCCNNNTGCATCAGGT | 203 | TGCAGGACCAGAGAATTCGAATACAGTTCCCANNNTGCATCAGGT | 443 | TGCAGGACCAGAGAATTCGAATACATTCTTCTTNNNTGCATCAGGT | 683 |
| TGCAGGACCAGAGAATTCGAATACACGGCCGCGNNNTGCATCAGGT | 204 | TGCAGGACCAGAGAATTCGAATACATTCAATAGNNNTGCATCAGGT | 444 | TGCAGGACCAGAGAATTCGAATACATTGTGGCANNNTGCATCAGGT | 684 |
| TGCAGGACCAGAGAATTCGAATACAATCTTTGTNNNTGCATCAGGT | 205 | TGCAGGACCAGAGAATTCGAATACATAGCCATGNNNTGCATCAGGT | 445 | TGCAGGACCAGAGAATTCGAATACATCCCATGTNNNTGCATCAGGT | 685 |
| TGCAGGACCAGAGAATTCGAATACATTGTACTTNNNTGCATCAGGT | 206 | TGCAGGACCAGAGAATTCGAATACAGTTGTTAANNNTGCATCAGGT | 446 | TGCAGGACCAGAGAATTCGAATACAGTGTTGACNNNTGCATCAGGT | 686 |

FIG. 12G

| Pool-1 | SEQ ID NO: | Pool-2 | SEQ ID NO: | Pool-3 | SEQ ID NO: |
|---|---|---|---|---|---|
| TGCAGGACCAGAGAATTCGAATACATGTTAATGNNNTGCATCAGGT | 207 | TGCAGGACCAGAGAATTCGAATACACTTGCACTNNNTGCATCAGGT | 447 | TGCAGGACCAGAGAATTCGAATACATCGCCTATNNNTGCATCAGGT | 687 |
| TGCAGGACCAGAGAATTCGAATACAAACATTGTNNNTGCATCAGGT | 208 | TGCAGGACCAGAGAATTCGAATACATTAGAGCCNNNTGCATCAGGT | 448 | TGCAGGACCAGAGAATTCGAATACACGCTGACGNNNTGCATCAGGT | 688 |
| TGCAGGACCAGAGAATTCGAATACACGCCCGAANNNTGCATCAGGT | 209 | TGCAGGACCAGAGAATTCGAATACAGCCCCTACNNNTGCATCAGGT | 449 | TGCAGGACCAGAGAATTCGAATACATGGTGGTTNNNTGCATCAGGT | 689 |
| TGCAGGACCAGAGAATTCGAATACACAGCGCACNNNTGCATCAGGT | 210 | TGCAGGACCAGAGAATTCGAATACAAATGGACGNNNTGCATCAGGT | 450 | TGCAGGACCAGAGAATTCGAATACACTATCTTANNNTGCATCAGGT | 690 |
| TGCAGGACCAGAGAATTCGAATACACGAGTATCNNNTGCATCAGGT | 211 | TGCAGGACCAGAGAATTCGAATACAAGACCTGTNNNTGCATCAGGT | 451 | TGCAGGACCAGAGAATTCGAATACAATAACCTANNNTGCATCAGGT | 691 |
| TGCAGGACCAGAGAATTCGAATACAATGGTGGANNNTGCATCAGGT | 212 | TGCAGGACCAGAGAATTCGAATACACTTACATTNNNTGCATCAGGT | 452 | TGCAGGACCAGAGAATTCGAATACAAGAGTGTGNNNTGCATCAGGT | 692 |
| TGCAGGACCAGAGAATTCGAATACATCACACTCNNNTGCATCAGGT | 213 | TGCAGGACCAGAGAATTCGAATACATAAGAAACNNNTGCATCAGGT | 453 | TGCAGGACCAGAGAATTCGAATACAAATGGCGANNNTGCATCAGGT | 693 |
| TGCAGGACCAGAGAATTCGAATACAGAAACGACNNNTGCATCAGGT | 214 | TGCAGGACCAGAGAATTCGAATACAGATTCTTTNNNTGCATCAGGT | 454 | TGCAGGACCAGAGAATTCGAATACAGTCTCTTGNNNTGCATCAGGT | 694 |
| TGCAGGACCAGAGAATTCGAATACAGAGTTTTANNNTGCATCAGGT | 215 | TGCAGGACCAGAGAATTCGAATACATCTAGGTGNNNTGCATCAGGT | 455 | TGCAGGACCAGAGAATTCGAATACATGCCCCANNNTGCATCAGGT | 695 |
| TGCAGGACCAGAGAATTCGAATACAGGCCTTTTNNNTGCATCAGGT | 216 | TGCAGGACCAGAGAATTCGAATACAGTGTCTTCNNNTGCATCAGGT | 456 | TGCAGGACCAGAGAATTCGAATACACGAGCTCGNNNTGCATCAGGT | 696 |
| TGCAGGACCAGAGAATTCGAATACACAACTCTCNNNTGCATCAGGT | 217 | TGCAGGACCAGAGAATTCGAATACATAAACTTGNNNTGCATCAGGT | 457 | TGCAGGACCAGAGAATTCGAATACAACTGAACCNNNTGCATCAGGT | 697 |
| TGCAGGACCAGAGAATTCGAATACATGTACTGGNNNTGCATCAGGT | 218 | TGCAGGACCAGAGAATTCGAATACAGACATCCANNNTGCATCAGGT | 458 | TGCAGGACCAGAGAATTCGAATACACTCGTATCNNNTGCATCAGGT | 698 |
| TGCAGGACCAGAGAATTCGAATACATTTGGCTCNNNTGCATCAGGT | 219 | TGCAGGACCAGAGAATTCGAATACATAAGTCCGNNNTGCATCAGGT | 459 | TGCAGGACCAGAGAATTCGAATACACACTTCCANNNTGCATCAGGT | 699 |
| TGCAGGACCAGAGAATTCGAATACAGAAGTATANNNTGCATCAGGT | 220 | TGCAGGACCAGAGAATTCGAATACAAGGCGCGANNNTGCATCAGGT | 460 | TGCAGGACCAGAGAATTCGAATACAGATCCTGANNNTGCATCAGGT | 700 |
| TGCAGGACCAGAGAATTCGAATACAGAATCACCNNNTGCATCAGGT | 221 | TGCAGGACCAGAGAATTCGAATACAGAGCTCTANNNTGCATCAGGT | 461 | TGCAGGACCAGAGAATTCGAATACAAGAAGTATNNNTGCATCAGGT | 701 |
| TGCAGGACCAGAGAATTCGAATACACTTACCGTNNNTGCATCAGGT | 222 | TGCAGGACCAGAGAATTCGAATACATCATAATGNNNTGCATCAGGT | 462 | TGCAGGACCAGAGAATTCGAATACAAACCCACANNNTGCATCAGGT | 702 |
| TGCAGGACCAGAGAATTCGAATACATCTTTACANNNTGCATCAGGT | 223 | TGCAGGACCAGAGAATTCGAATACAGGATGGTANNNTGCATCAGGT | 463 | TGCAGGACCAGAGAATTCGAATACATGCCGAATNNNTGCATCAGGT | 703 |
| TGCAGGACCAGAGAATTCGAATACACGAAGTGANNNTGCATCAGGT | 224 | TGCAGGACCAGAGAATTCGAATACATAGCCTTCNNNTGCATCAGGT | 464 | TGCAGGACCAGAGAATTCGAATACAATCAGAGGNNNTGCATCAGGT | 704 |
| TGCAGGACCAGAGAATTCGAATACACTTGTGGANNNTGCATCAGGT | 225 | TGCAGGACCAGAGAATTCGAATACAATCCCGCNNNTGCATCAGGT | 465 | TGCAGGACCAGAGAATTCGAATACAGTCATATANNNTGCATCAGGT | 705 |
| TGCAGGACCAGAGAATTCGAATACAGTTCTCTGNNNTGCATCAGGT | 226 | TGCAGGACCAGAGAATTCGAATACAGATTGCTGNNNTGCATCAGGT | 466 | TGCAGGACCAGAGAATTCGAATACAACCCACCNNNTGCATCAGGT | 706 |
| TGCAGGACCAGAGAATTCGAATACACCTTCAACNNNTGCATCAGGT | 227 | TGCAGGACCAGAGAATTCGAATACAGTGATGAGNNNTGCATCAGGT | 467 | TGCAGGACCAGAGAATTCGAATACACCCACAGGNNNTGCATCAGGT | 707 |
| TGCAGGACCAGAGAATTCGAATACAAAATGCTTNNNTGCATCAGGT | 228 | TGCAGGACCAGAGAATTCGAATACACGGAACGNNNTGCATCAGGT | 468 | TGCAGGACCAGAGAATTCGAATACATGCTGAACNNNTGCATCAGGT | 708 |
| TGCAGGACCAGAGAATTCGAATACAATCGCGATNNNTGCATCAGGT | 229 | TGCAGGACCAGAGAATTCGAATACAGCTCTTTGNNNTGCATCAGGT | 469 | TGCAGGACCAGAGAATTCGAATACAGCAGCATTNNNTGCATCAGGT | 709 |
| TGCAGGACCAGAGAATTCGAATACAGGCTCGTGNNNTGCATCAGGT | 230 | TGCAGGACCAGAGAATTCGAATACAGTAATCGCNNNTGCATCAGGT | 470 | TGCAGGACCAGAGAATTCGAATACAGGCGATGGNNNTGCATCAGGT | 710 |
| TGCAGGACCAGAGAATTCGAATACAGACCCTAANNNTGCATCAGGT | 231 | TGCAGGACCAGAGAATTCGAATACACTTGTTATNNNTGCATCAGGT | 471 | TGCAGGACCAGAGAATTCGAATACATTCGATGGNNNTGCATCAGGT | 711 |
| TGCAGGACCAGAGAATTCGAATACACAAATTTGNNNTGCATCAGGT | 232 | TGCAGGACCAGAGAATTCGAATACACACACANNNTGCATCAGGT | 472 | TGCAGGACCAGAGAATTCGAATACATGGACGCGNNNTGCATCAGGT | 712 |
| TGCAGGACCAGAGAATTCGAATACATTTTTTCCNNNTGCATCAGGT | 233 | TGCAGGACCAGAGAATTCGAATACATAAATAANNNTGCATCAGGT | 473 | TGCAGGACCAGAGAATTCGAATACAGTATTACANNNTGCATCAGGT | 713 |
| TGCAGGACCAGAGAATTCGAATACATTTAACGANNNTGCATCAGGT | 234 | TGCAGGACCAGAGAATTCGAATACAAACGCATCNNNTGCATCAGGT | 474 | TGCAGGACCAGAGAATTCGAATACACGACAATCNNNTGCATCAGGT | 714 |
| TGCAGGACCAGAGAATTCGAATACAGTGGTCTANNNTGCATCAGGT | 235 | TGCAGGACCAGAGAATTCGAATACACATATGATNNNTGCATCAGGT | 475 | TGCAGGACCAGAGAATTCGAATACAGTGGCCACNNNTGCATCAGGT | 715 |
| TGCAGGACCAGAGAATTCGAATACATTCTAATCNNNTGCATCAGGT | 236 | TGCAGGACCAGAGAATTCGAATACAGCGTCATANNNTGCATCAGGT | 476 | TGCAGGACCAGAGAATTCGAATACATACGCGCGNNNTGCATCAGGT | 716 |
| TGCAGGACCAGAGAATTCGAATACAATTGATTGNNNTGCATCAGGT | 237 | TGCAGGACCAGAGAATTCGAATACATAAGCCTANNNTGCATCAGGT | 477 | TGCAGGACCAGAGAATTCGAATACACGAAGACANNNTGCATCAGGT | 717 |
| TGCAGGACCAGAGAATTCGAATACATGCATAGCNNNTGCATCAGGT | 238 | TGCAGGACCAGAGAATTCGAATACATAGCAGAGNNNTGCATCAGGT | 478 | TGCAGGACCAGAGAATTCGAATACACCAATGACNNNTGCATCAGGT | 718 |
| TGCAGGACCAGAGAATTCGAATACAGACAGATGNNNTGCATCAGGT | 239 | TGCAGGACCAGAGAATTCGAATACACTTGGAACNNNTGCATCAGGT | 479 | TGCAGGACCAGAGAATTCGAATACAAGCCTTCTNNNTGCATCAGGT | 719 |

FIG. 12H

| Pool-1 | SEQ ID NO: | Pool-2 | SEQ ID NO: | Pool-3 | SEQ ID NO: |
|---|---|---|---|---|---|
| TGCAGGACCAGAGAATTCGAATA CATGCTCTACNNNTGCATCAGGT | 240 | TGCAGGACCAGAGAATTCGAATA CAACCGAGAANNNTGCATCAGGT | 480 | TGCAGGACCAGAGAATTCGAATA CATATCACCCNNNTGCATCAGGT | 720 |
| TGCAGGACCAGAGAATTCGAATA CATGCGATACNNNTGCATCAGGT | 241 | TGCAGGACCAGAGAATTCGAATA CACTATCTATNNNTGCATCAGGT | 481 | TGCAGGACCAGAGAATTCGAATA CACCTTATGCNNNTGCATCAGGT | 721 |
| TGCAGGACCAGAGAATTCGAATA CAACACTGCANNNTGCATCAGGT | 242 | TGCAGGACCAGAGAATTCGAATA CACAATTTAGNNNTGCATCAGGT | 482 | TGCAGGACCAGAGAATTCGAATA CATTAATGACNNNTGCATCAGGT | 722 |
| TGCAGGACCAGAGAATTCGAATA CAGTCACTCTNNNTGCATCAGGT | 243 | TGCAGGACCAGAGAATTCGAATA CACTAAACGCNNNTGCATCAGGT | 483 | TGCAGGACCAGAGAATTCGAATA CACTACCTTGNNNTGCATCAGGT | 723 |
| TGCAGGACCAGAGAATTCGAATA CATTGTATTCNNNTGCATCAGGT | 244 | TGCAGGACCAGAGAATTCGAATA CATAGTAGAANNNTGCATCAGGT | 484 | TGCAGGACCAGAGAATTCGAATA CAAGGATCTCNNNTGCATCAGGT | 724 |
| TGCAGGACCAGAGAATTCGAATA CAAACCTAGCNNNTGCATCAGGT | 245 | TGCAGGACCAGAGAATTCGAATA CAGCAAAGTGNNNTGCATCAGGT | 485 | TGCAGGACCAGAGAATTCGAATA CAAAGATCAANNNTGCATCAGGT | 725 |
| TGCAGGACCAGAGAATTCGAATA CAGCCGGATCNNNTGCATCAGGT | 246 | TGCAGGACCAGAGAATTCGAATA CACAAGTTATNNNTGCATCAGGT | 486 | TGCAGGACCAGAGAATTCGAATA CAGAATGAGCNNNTGCATCAGGT | 726 |
| TGCAGGACCAGAGAATTCGAATA CAAGGATCCTNNNTGCATCAGGT | 247 | TGCAGGACCAGAGAATTCGAATA CACAACTGACNNNTGCATCAGGT | 487 | TGCAGGACCAGAGAATTCGAATA CAACTAGATTNNNTGCATCAGGT | 727 |
| TGCAGGACCAGAGAATTCGAATA CATACTGGACNNNTGCATCAGGT | 248 | TGCAGGACCAGAGAATTCGAATA CATTCGTCGTNNNTGCATCAGGT | 488 | TGCAGGACCAGAGAATTCGAATA CATTTTCCGGNNNTGCATCAGGT | 728 |

FIG. 13A

| Pool-4 | SEQ ID NO: | Pool-5 | SEQ ID NO: | Pool-6 | SEQ ID NO: |
|---|---|---|---|---|---|
| TGCAGGACCAGAGAATTCGAATA CATATGCGCANNNACGTATGCCA | 729 | TGCAGGACCAGAGAATTCGAATA CAGCGATTACNNNACGTATGCCA | 969 | TGCAGGACCAGAGAATTCGAATA CACAATGACCNNNACGTATGCCA | 1209 |
| TGCAGGACCAGAGAATTCGAATA CAGTTCACCTNNNACGTATGCCA | 730 | TGCAGGACCAGAGAATTCGAATA CATGGTCCTCNNNACGTATGCCA | 970 | TGCAGGACCAGAGAATTCGAATA CAGCTACGTANNNACGTATGCCA | 1210 |
| TGCAGGACCAGAGAATTCGAATA CATCCTACACNNNACGTATGCCA | 731 | TGCAGGACCAGAGAATTCGAATA CAGTTATAACNNNACGTATGCCA | 971 | TGCAGGACCAGAGAATTCGAATA CAGCCAGCACNNNACGTATGCCA | 1211 |
| TGCAGGACCAGAGAATTCGAATA CACTACTCTGNNNACGTATGCCA | 732 | TGCAGGACCAGAGAATTCGAATA CGTATCTTCANNNACGTATGCCA | 972 | TGCAGGACCAGAGAATTCGAATA CACGATCCGGNNNACGTATGCCA | 1212 |
| TGCAGGACCAGAGAATTCGAATA CACCTTCCCCNNNACGTATGCCA | 733 | TGCAGGACCAGAGAATTCGAATA CAACGTTCGANNNACGTATGCCA | 973 | TGCAGGACCAGAGAATTCGAATA CATTGGACACNNNACGTATGCCA | 1213 |
| TGCAGGACCAGAGAATTCGAATA CAGAAGATCGNNNACGTATGCCA | 734 | TGCAGGACCAGAGAATTCGAATA CAACTCGTGANNNACGTATGCCA | 974 | TGCAGGACCAGAGAATTCGAATA CAACAATGCCNNNACGTATGCCA | 1214 |
| TGCAGGACCAGAGAATTCGAATA CACTCCGCTGNNNACGTATGCCA | 735 | TGCAGGACCAGAGAATTCGAATA CAGGACTACTNNNACGTATGCCA | 975 | TGCAGGACCAGAGAATTCGAATA CACCTTTATANNNACGTATGCCA | 1215 |
| TGCAGGACCAGAGAATTCGAATA CATATGTCCCNNNACGTATGCCA | 736 | TGCAGGACCAGAGAATTCGAATA CATCTGTACCNNNACGTATGCCA | 976 | TGCAGGACCAGAGAATTCGAATA CAGTGGCTGCNNNACGTATGCCA | 1216 |
| TGCAGGACCAGAGAATTCGAATA CATATTTGCTNNNACGTATGCCA | 737 | TGCAGGACCAGAGAATTCGAATA CACCCTAACTNNNACGTATGCCA | 977 | TGCAGGACCAGAGAATTCGAATA CAATCTCCGTNNNACGTATGCCA | 1217 |
| TGCAGGACCAGAGAATTCGAATA CAGTCCAGGCNNNACGTATGCCA | 738 | TGCAGGACCAGAGAATTCGAATA CATTGGAGAGNNNACGTATGCCA | 978 | TGCAGGACCAGAGAATTCGAATA CAATGGCCATNNNACGTATGCCA | 1218 |
| TGCAGGACCAGAGAATTCGAATA CAAAGATGGCNNNACGTATGCCA | 739 | TGCAGGACCAGAGAATTCGAATA CAGAATCAAANNNACGTATGCCA | 979 | TGCAGGACCAGAGAATTCGAATA CATTTGATAGNNNACGTATGCCA | 1219 |
| TGCAGGACCAGAGAATTCGAATA CAGTCCCGAGNNNACGTATGCCA | 740 | TGCAGGACCAGAGAATTCGAATA CAGTTTCGTCNNNACGTATGCCA | 980 | TGCAGGACCAGAGAATTCGAATA CAGTCCCGGANNNACGTATGCCA | 1220 |
| TGCAGGACCAGAGAATTCGAATA CAAGGTTTCGNNNACGTATGCCA | 741 | TGCAGGACCAGAGAATTCGAATA CACTACACAGNNNACGTATGCCA | 981 | TGCAGGACCAGAGAATTCGAATA CAGGGTTCAANNNACGTATGCCA | 1221 |
| TGCAGGACCAGAGAATTCGAATA CATGCAAAGGNNNACGTATGCCA | 742 | TGCAGGACCAGAGAATTCGAATA CAAGTCAGTCNNNACGTATGCCA | 982 | TGCAGGACCAGAGAATTCGAATA CACCTTTTTTNNNACGTATGCCA | 1222 |
| TGCAGGACCAGAGAATTCGAATA CAAGGTGTAGNNNACGTATGCCA | 743 | TGCAGGACCAGAGAATTCGAATA CACAACGAGANNNACGTATGCCA | 983 | TGCAGGACCAGAGAATTCGAATA CAACGCCCGANNNACGTATGCCA | 1223 |
| TGCAGGACCAGAGAATTCGAATA CACACGAGTTNNNACGTATGCCA | 744 | TGCAGGACCAGAGAATTCGAATA CATAGGCTCANNNACGTATGCCA | 984 | TGCAGGACCAGAGAATTCGAATA CACCCCTAGCNNNACGTATGCCA | 1224 |
| TGCAGGACCAGAGAATTCGAATA CACACCGCCTNNNACGTATGCCA | 745 | TGCAGGACCAGAGAATTCGAATA CAGGCCCATGNNNACGTATGCCA | 985 | TGCAGGACCAGAGAATTCGAATA CACGGAGGCANNNACGTATGCCA | 1225 |
| TGCAGGACCAGAGAATTCGAATA CAAAGCTACCNNNACGTATGCCA | 746 | TGCAGGACCAGAGAATTCGAATA CAGGCCAGTCCNNNACGTATGCCA | 986 | TGCAGGACCAGAGAATTCGAATA CACTATGAATNNNACGTATGCCA | 1226 |
| TGCAGGACCAGAGAATTCGAATA CAGAACCGAANNNACGTATGCCA | 747 | TGCAGGACCAGAGAATTCGAATA CATCGATTGGNNNACGTATGCCA | 987 | TGCAGGACCAGAGAATTCGAATA CAGACCGCGTNNNACGTATGCCA | 1227 |
| TGCAGGACCAGAGAATTCGAATA CAAGTACTGCNNNACGTATGCCA | 748 | TGCAGGACCAGAGAATTCGAATA CATGGACAGGNNNACGTATGCCA | 988 | TGCAGGACCAGAGAATTCGAATA CATACTAGTANNNACGTATGCCA | 1228 |
| TGCAGGACCAGAGAATTCGAATA CAAACAATTCNNNACGTATGCCA | 749 | TGCAGGACCAGAGAATTCGAATA CAACTAAGTTNNNACGTATGCCA | 989 | TGCAGGACCAGAGAATTCGAATA CAACCAGTGTNNNACGTATGCCA | 1229 |
| TGCAGGACCAGAGAATTCGAATA CAGTATTAACNNNACGTATGCCA | 750 | TGCAGGACCAGAGAATTCGAATA CAATGTTCGGNNNACGTATGCCA | 990 | TGCAGGACCAGAGAATTCGAATA CAGATGCCTANNNACGTATGCCA | 1230 |
| TGCAGGACCAGAGAATTCGAATA CATGATTATGNNNACGTATGCCA | 751 | TGCAGGACCAGAGAATTCGAATA CAAGCCCAATNNNACGTATGCCA | 991 | TGCAGGACCAGAGAATTCGAATA CACCATATTTNNNACGTATGCCA | 1231 |
| TGCAGGACCAGAGAATTCGAATA CAGCAAACCTNNNACGTATGCCA | 752 | TGCAGGACCAGAGAATTCGAATA CAGTGAGTTCNNNACGTATGCCA | 992 | TGCAGGACCAGAGAATTCGAATA CAAAACCACCNNNACGTATGCCA | 1232 |
| TGCAGGACCAGAGAATTCGAATA CAGAATCTTANNNACGTATGCCA | 753 | TGCAGGACCAGAGAATTCGAATA CAGTGCTAACNNNACGTATGCCA | 993 | TGCAGGACCAGAGAATTCGAATA CAGCACGAAANNNACGTATGCCA | 1233 |
| TGCAGGACCAGAGAATTCGAATA CAGAGGACGCNNNACGTATGCCA | 754 | TGCAGGACCAGAGAATTCGAATA CAGCCACCGANNNACGTATGCCA | 994 | TGCAGGACCAGAGAATTCGAATA CAACGACAGANNNACGTATGCCA | 1234 |
| TGCAGGACCAGAGAATTCGAATA CAAGCCAAAGNNNACGTATGCCA | 755 | TGCAGGACCAGAGAATTCGAATA CAAGTCCGATNNNACGTATGCCA | 995 | TGCAGGACCAGAGAATTCGAATA CAATACCATANNNACGTATGCCA | 1235 |
| TGCAGGACCAGAGAATTCGAATA CAGGACGCTCNNNACGTATGCCA | 756 | TGCAGGACCAGAGAATTCGAATA CAGTTAAATCNNNACGTATGCCA | 996 | TGCAGGACCAGAGAATTCGAATA CACCAGTTCCNNNACGTATGCCA | 1236 |
| TGCAGGACCAGAGAATTCGAATA CAGCTGCCCTNNNACGTATGCCA | 757 | TGCAGGACCAGAGAATTCGAATA CAACTGACTGNNNACGTATGCCA | 997 | TGCAGGACCAGAGAATTCGAATA CATTGCTGGANNNACGTATGCCA | 1237 |
| TGCAGGACCAGAGAATTCGAATA CACCCTTTTCNNNACGTATGCCA | 758 | TGCAGGACCAGAGAATTCGAATA CACTTCATGCNNNACGTATGCCA | 998 | TGCAGGACCAGAGAATTCGAATA CAGCCCATTNNNACGTATGCCA | 1238 |
| TGCAGGACCAGAGAATTCGAATA CATCGCAGTANNNACGTATGCCA | 759 | TGCAGGACCAGAGAATTCGAATA CAACCAGATNNNACGTATGCCA | 999 | TGCAGGACCAGAGAATTCGAATA CAAACAGTANNNACGTATGCCA | 1239 |
| TGCAGGACCAGAGAATTCGAATA CAATCGCATGNNNACGTATGCCA | 760 | TGCAGGACCAGAGAATTCGAATA CAGCCGTCCANNNACGTATGCCA | 1000 | TGCAGGACCAGAGAATTCGAATA CACTGTTCTGNNNACGTATGCCA | 1240 |

FIG. 13B

| Pool-4 | SEQ ID NO: | Pool-5 | SEQ ID NO: | Pool-6 | SEQ ID NO: |
|---|---|---|---|---|---|
| TGCAGGACCAGAGAATTCGAATA CAAGATGGCANNNACGTATGCCA | 761 | TGCAGGACCAGAGAATTCGAATA CAAACAACCCNNNACGTATGCCA | 1001 | TGCAGGACCAGAGAATTCGAATA CATGCAATAANNNACGTATGCCA | 1241 |
| TGCAGGACCAGAGAATTCGAATA CATCATCGCTNNNACGTATGCCA | 762 | TGCAGGACCAGAGAATTCGAATA CAGGTCTTAGNNNACGTATGCCA | 1002 | TGCAGGACCAGAGAATTCGAATA CATTCCCTTCNNNACGTATGCCA | 1242 |
| TGCAGGACCAGAGAATTCGAATA CACGTGTTCTNNNACGTATGCCA | 763 | TGCAGGACCAGAGAATTCGAATA CAGCCCGGATNNNACGTATGCCA | 1003 | TGCAGGACCAGAGAATTCGAATA CACACGCAATNNNACGTATGCCA | 1243 |
| TGCAGGACCAGAGAATTCGAATA CAGGTTATTANNNACGTATGCCA | 764 | TGCAGGACCAGAGAATTCGAATA CAATCCCGAANNNACGTATGCCA | 1004 | TGCAGGACCAGAGAATTCGAATA CAGCTTATCCNNNACGTATGCCA | 1244 |
| TGCAGGACCAGAGAATTCGAATA CAAGAGTTAANNNACGTATGCCA | 765 | TGCAGGACCAGAGAATTCGAATA CATTTACTCANNNACGTATGCCA | 1005 | TGCAGGACCAGAGAATTCGAATA CAGGCATAGANNNACGTATGCCA | 1245 |
| TGCAGGACCAGAGAATTCGAATA CATGAAATTCNNNACGTATGCCA | 766 | TGCAGGACCAGAGAATTCGAATA CATCCACCGCNNNACGTATGCCA | 1006 | TGCAGGACCAGAGAATTCGAATA CAAGCGCCGTNNNACGTATGCCA | 1246 |
| TGCAGGACCAGAGAATTCGAATA CACTTACCTGNNNACGTATGCCA | 767 | TGCAGGACCAGAGAATTCGAATA CACCAGATTGNNNACGTATGCCA | 1007 | TGCAGGACCAGAGAATTCGAATA CACAAATTCANNNACGTATGCCA | 1247 |
| TGCAGGACCAGAGAATTCGAATA CAAACTCGTGNNNACGTATGCCA | 768 | TGCAGGACCAGAGAATTCGAATA CACATGGTCANNNACGTATGCCA | 1008 | TGCAGGACCAGAGAATTCGAATA CATAATGCATNNNACGTATGCCA | 1248 |
| TGCAGGACCAGAGAATTCGAATA CAGGACACGGNNNACGTATGCCA | 769 | TGCAGGACCAGAGAATTCGAATA CACCATTCGNNNACGTATGCCA | 1009 | TGCAGGACCAGAGAATTCGAATA CAACTCGTCTNNNACGTATGCCA | 1249 |
| TGCAGGACCAGAGAATTCGAATA CATCTCGCGCNNNACGTATGCCA | 770 | TGCAGGACCAGAGAATTCGAATA CATGTCGCGGNNNACGTATGCCA | 1010 | TGCAGGACCAGAGAATTCGAATA CAAATTTGTGNNNACGTATGCCA | 1250 |
| TGCAGGACCAGAGAATTCGAATA CACTTCCAGTNNNACGTATGCCA | 771 | TGCAGGACCAGAGAATTCGAATA CAAACAATAGNNNACGTATGCCA | 1011 | TGCAGGACCAGAGAATTCGAATA CATGGAGGTNNNACGTATGCCA | 1251 |
| TGCAGGACCAGAGAATTCGAATA CAATAGTTACNNNACGTATGCCA | 772 | TGCAGGACCAGAGAATTCGAATA CATTCGACGANNNACGTATGCCA | 1012 | TGCAGGACCAGAGAATTCGAATA CAGCCATACANNNACGTATGCCA | 1252 |
| TGCAGGACCAGAGAATTCGAATA CACGACTTGANNNACGTATGCCA | 773 | TGCAGGACCAGAGAATTCGAATA CACCTTGAGANNNACGTATGCCA | 1013 | TGCAGGACCAGAGAATTCGAATA CAGTCCTTCANNNACGTATGCCA | 1253 |
| TGCAGGACCAGAGAATTCGAATA CATGCTTTATNNNACGTATGCCA | 774 | TGCAGGACCAGAGAATTCGAATA CAACGCTCTTNNNACGTATGCCA | 1014 | TGCAGGACCAGAGAATTCGAATA CAGTGCGGAGNNNACGTATGCCA | 1254 |
| TGCAGGACCAGAGAATTCGAATA CAGCCACTTTNNNACGTATGCCA | 775 | TGCAGGACCAGAGAATTCGAATA CACACGAAGANNNACGTATGCCA | 1015 | TGCAGGACCAGAGAATTCGAATA CATTTAGACANNNACGTATGCCA | 1255 |
| TGCAGGACCAGAGAATTCGAATA CATATCGGACNNNACGTATGCCA | 776 | TGCAGGACCAGAGAATTCGAATA CAGGCCACACNNNACGTATGCCA | 1016 | TGCAGGACCAGAGAATTCGAATA CACACCCGCTNNNACGTATGCCA | 1256 |
| TGCAGGACCAGAGAATTCGAATA CAATTCCATTNNNACGTATGCCA | 777 | TGCAGGACCAGAGAATTCGAATA CATCTGTGAGNNNACGTATGCCA | 1017 | TGCAGGACCAGAGAATTCGAATA CAATTCTAGANNNACGTATGCCA | 1257 |
| TGCAGGACCAGAGAATTCGAATA CAAATGCTGCNNNACGTATGCCA | 778 | TGCAGGACCAGAGAATTCGAATA CAAAAGCCAGNNNACGTATGCCA | 1018 | TGCAGGACCAGAGAATTCGAATA CACGGACGAGNNNACGTATGCCA | 1258 |
| TGCAGGACCAGAGAATTCGAATA CAACGCGATTNNNACGTATGCCA | 779 | TGCAGGACCAGAGAATTCGAATA CACCAGTTGANNNACGTATGCCA | 1019 | TGCAGGACCAGAGAATTCGAATA CACGACCCANNNACGTATGCCA | 1259 |
| TGCAGGACCAGAGAATTCGAATA CATAGCTAGCNNNACGTATGCCA | 780 | TGCAGGACCAGAGAATTCGAATA CACTTGTAGGNNNACGTATGCCA | 1020 | TGCAGGACCAGAGAATTCGAATA CACATATAGTNNNACGTATGCCA | 1260 |
| TGCAGGACCAGAGAATTCGAATA CAGCAACGTTNNNACGTATGCCA | 781 | TGCAGGACCAGAGAATTCGAATA CAATATGCATNNNACGTATGCCA | 1021 | TGCAGGACCAGAGAATTCGAATA CATGTGATATNNNACGTATGCCA | 1261 |
| TGCAGGACCAGAGAATTCGAATA CACGTCCTATNNNACGTATGCCA | 782 | TGCAGGACCAGAGAATTCGAATA CACCAGGCGTNNNACGTATGCCA | 1022 | TGCAGGACCAGAGAATTCGAATA CAATCCTAAANNNACGTATGCCA | 1262 |
| TGCAGGACCAGAGAATTCGAATA CAGCCACACGNNNACGTATGCCA | 783 | TGCAGGACCAGAGAATTCGAATA CAATGTTTAGNNNACGTATGCCA | 1023 | TGCAGGACCAGAGAATTCGAATA CATGATGAGGNNNACGTATGCCA | 1263 |
| TGCAGGACCAGAGAATTCGAATA CAGGCTTCCCNNNACGTATGCCA | 784 | TGCAGGACCAGAGAATTCGAATA CACTGTCCGCNNNACGTATGCCA | 1024 | TGCAGGACCAGAGAATTCGAATA CAGCTCGACGNNNACGTATGCCA | 1264 |
| TGCAGGACCAGAGAATTCGAATA CAGTTGACACNNNACGTATGCCA | 785 | TGCAGGACCAGAGAATTCGAATA CATTTTACCANNNACGTATGCCA | 1025 | TGCAGGACCAGAGAATTCGAATA CATTAGCTAANNNACGTATGCCA | 1265 |
| TGCAGGACCAGAGAATTCGAATA CAGCATCTTCNNNACGTATGCCA | 786 | TGCAGGACCAGAGAATTCGAATA CATGCCCTGCNNNACGTATGCCA | 1026 | TGCAGGACCAGAGAATTCGAATA CATGCTTTANNNACGTATGCCA | 1266 |
| TGCAGGACCAGAGAATTCGAATA CAACAATTGTNNNACGTATGCCA | 787 | TGCAGGACCAGAGAATTCGAATA CACCTTTGACNNNACGTATGCCA | 1027 | TGCAGGACCAGAGAATTCGAATA CAATCACAGCNNNACGTATGCCA | 1267 |
| TGCAGGACCAGAGAATTCGAATA CAGATCCCCNNNACGTATGCCA | 788 | TGCAGGACCAGAGAATTCGAATA CAATTATTTTNNNACGTATGCCA | 1028 | TGCAGGACCAGAGAATTCGAATA CAAATCTCGGNNNACGTATGCCA | 1268 |
| TGCAGGACCAGAGAATTCGAATA CAGCCCAGTGNNNCTAGCGTTAC | 789 | TGCAGGACCAGAGAATTCGAATA CAGTGTGGAANNNCTAGCGTTAC | 1029 | TGCAGGACCAGAGAATTCGAATA CAACACTGGTNNNCTAGCGTTAC | 1269 |
| TGCAGGACCAGAGAATTCGAATA CAGCGGTGCTNNNCTAGCGTTAC | 790 | TGCAGGACCAGAGAATTCGAATA CAACTCGTAGNNNCTAGCGTTAC | 1030 | TGCAGGACCAGAGAATTCGAATA CATTTGTTTGNNNCTAGCGTTAC | 1270 |
| TGCAGGACCAGAGAATTCGAATA CATACGTGCANNNCTAGCGTTAC | 791 | TGCAGGACCAGAGAATTCGAATA CATCGCGTCCNNNCTAGCGTTAC | 1031 | TGCAGGACCAGAGAATTCGAATA CACGACACGGNNNCTAGCGTTAC | 1271 |
| TGCAGGACCAGAGAATTCGAATA CACACCCACCNNNCTAGCGTTAC | 792 | TGCAGGACCAGAGAATTCGAATA CAGCCTAATGNNNCTAGCGTTAC | 1032 | TGCAGGACCAGAGAATTCGAATA CACGCGAGAGNNNCTAGCGTTAC | 1272 |

FIG. 13C

| Pool-4 | SEQ ID NO: | Pool-5 | SEQ ID NO: | Pool-6 | SEQ ID NO: |
|---|---|---|---|---|---|
| TGCAGGACCAGAGAATTCGAATACACACAGAAGNNNCTAGCGTTAC | 793 | TGCAGGACCAGAGAATTCGAATACAGCGTGTTANNNCTAGCGTTAC | 1033 | TGCAGGACCAGAGAATTCGAATACATAAGTAGANNNCTAGCGTTAC | 1273 |
| TGCAGGACCAGAGAATTCGAATACACGCTAACANNNCTAGCGTTAC | 794 | TGCAGGACCAGAGAATTCGAATACACGAGAAACNNNCTAGCGTTAC | 1034 | TGCAGGACCAGAGAATTCGAATACAAAGACGTGNNNCTAGCGTTAC | 1274 |
| TGCAGGACCAGAGAATTCGAATACAGACCTATGNNNCTAGCGTTAC | 795 | TGCAGGACCAGAGAATTCGAATACAATGCTCAGNNNCTAGCGTTAC | 1035 | TGCAGGACCAGAGAATTCGAATACACGGAACANNNCTAGCGTTAC | 1275 |
| TGCAGGACCAGAGAATTCGAATACAAAAAGGAANNNCTAGCGTTAC | 796 | TGCAGGACCAGAGAATTCGAATACAGTCAGCTANNNCTAGCGTTAC | 1036 | TGCAGGACCAGAGAATTCGAATACACTGTCGAANNNCTAGCGTTAC | 1276 |
| TGCAGGACCAGAGAATTCGAATACAACAGAGGTNNNCTAGCGTTAC | 797 | TGCAGGACCAGAGAATTCGAATACAGGTAGCGNNNCTAGCGTTAC | 1037 | TGCAGGACCAGAGAATTCGAATACAAGCCTACANNNCTAGCGTTAC | 1277 |
| TGCAGGACCAGAGAATTCGAATACACGTAGCATNNNCTAGCGTTAC | 798 | TGCAGGACCAGAGAATTCGAATACACCTGGTCCNNNCTAGCGTTAC | 1038 | TGCAGGACCAGAGAATTCGAATACACCAATTCGNNNCTAGCGTTAC | 1278 |
| TGCAGGACCAGAGAATTCGAATACATCCCCAGCNNNCTAGCGTTAC | 799 | TGCAGGACCAGAGAATTCGAATACACAGCACCGNNNCTAGCGTTAC | 1039 | TGCAGGACCAGAGAATTCGAATACAGAGTCTACNNNCTAGCGTTAC | 1279 |
| TGCAGGACCAGAGAATTCGAATACAGTACCTGNNNCTAGCGTTAC | 800 | TGCAGGACCAGAGAATTCGAATACACATTGTGGNNNCTAGCGTTAC | 1040 | TGCAGGACCAGAGAATTCGAATACAAATGTTACNNNCTAGCGTTAC | 1280 |
| TGCAGGACCAGAGAATTCGAATACAAGAGAGGANNNCTAGCGTTAC | 801 | TGCAGGACCAGAGAATTCGAATACAAGGAACTGNNNCTAGCGTTAC | 1041 | TGCAGGACCAGAGAATTCGAATACAAGTGGCAANNNCTAGCGTTAC | 1281 |
| TGCAGGACCAGAGAATTCGAATACAGTAACTCGNNNCTAGCGTTAC | 802 | TGCAGGACCAGAGAATTCGAATACAGTTATTAGNNNCTAGCGTTAC | 1042 | TGCAGGACCAGAGAATTCGAATACAGGTTAACCNNNCTAGCGTTAC | 1282 |
| TGCAGGACCAGAGAATTCGAATACAGGTACATCNNNCTAGCGTTAC | 803 | TGCAGGACCAGAGAATTCGAATACAAATCTTCTNNNCTAGCGTTAC | 1043 | TGCAGGACCAGAGAATTCGAATACATTGTGGTGNNNCTAGCGTTAC | 1283 |
| TGCAGGACCAGAGAATTCGAATACAGTTAACCGNNNCTAGCGTTAC | 804 | TGCAGGACCAGAGAATTCGAATACAGACAATCCNNNCTAGCGTTAC | 1044 | TGCAGGACCAGAGAATTCGAATACAAAATGGCGNNNCTAGCGTTAC | 1284 |
| TGCAGGACCAGAGAATTCGAATACAAACGAGTGNNNCTAGCGTTAC | 805 | TGCAGGACCAGAGAATTCGAATACAATCTAGATNNNCTAGCGTTAC | 1045 | TGCAGGACCAGAGAATTCGAATACACTGTAGGTNNNCTAGCGTTAC | 1285 |
| TGCAGGACCAGAGAATTCGAATACATCTCACTGNNNCTAGCGTTAC | 806 | TGCAGGACCAGAGAATTCGAATACAGCGACGTCNNNCTAGCGTTAC | 1046 | TGCAGGACCAGAGAATTCGAATACACTAAGCGTNNNCTAGCGTTAC | 1286 |
| TGCAGGACCAGAGAATTCGAATACATACGAGCTNNNCTAGCGTTAC | 807 | TGCAGGACCAGAGAATTCGAATACACACCCCGTNNNCTAGCGTTAC | 1047 | TGCAGGACCAGAGAATTCGAATACAGTTTATGANNNCTAGCGTTAC | 1287 |
| TGCAGGACCAGAGAATTCGAATACACAGATACCNNNCTAGCGTTAC | 808 | TGCAGGACCAGAGAATTCGAATACACGCCTCGTNNNCTAGCGTTAC | 1048 | TGCAGGACCAGAGAATTCGAATACAACGACTGTNNNCTAGCGTTAC | 1288 |
| TGCAGGACCAGAGAATTCGAATACATACATTCNNNCTAGCGTTAC | 809 | TGCAGGACCAGAGAATTCGAATACACTGACACANNNCTAGCGTTAC | 1049 | TGCAGGACCAGAGAATTCGAATACACCTAGTAGNNNCTAGCGTTAC | 1289 |
| TGCAGGACCAGAGAATTCGAATACAGTGTAAGGNNNCTAGCGTTAC | 810 | TGCAGGACCAGAGAATTCGAATACATGCTTTGCNNNCTAGCGTTAC | 1050 | TGCAGGACCAGAGAATTCGAATACAGGTTCTGANNNCTAGCGTTAC | 1290 |
| TGCAGGACCAGAGAATTCGAATACAGGTTGAAGNNNCTAGCGTTAC | 811 | TGCAGGACCAGAGAATTCGAATACAACTGTCTCNNNCTAGCGTTAC | 1051 | TGCAGGACCAGAGAATTCGAATACATACATCCCNNNCTAGCGTTAC | 1291 |
| TGCAGGACCAGAGAATTCGAATACACGTCCCTGNNNCTAGCGTTAC | 812 | TGCAGGACCAGAGAATTCGAATACATATTGTCTNNNCTAGCGTTAC | 1052 | TGCAGGACCAGAGAATTCGAATACACTCGGAATNNNCTAGCGTTAC | 1292 |
| TGCAGGACCAGAGAATTCGAATACAAATCCCTCNNNCTAGCGTTAC | 813 | TGCAGGACCAGAGAATTCGAATACAATTTGACANNNCTAGCGTTAC | 1053 | TGCAGGACCAGAGAATTCGAATACATCAGTTGGNNNCTAGCGTTAC | 1293 |
| TGCAGGACCAGAGAATTCGAATACATGCCCACNNNCTAGCGTTAC | 814 | TGCAGGACCAGAGAATTCGAATACACGCACACGNNNCTAGCGTTAC | 1054 | TGCAGGACCAGAGAATTCGAATACAAGTGCCTANNNCTAGCGTTAC | 1294 |
| TGCAGGACCAGAGAATTCGAATACAGTATTATGNNNCTAGCGTTAC | 815 | TGCAGGACCAGAGAATTCGAATACACCCGGAACNNNCTAGCGTTAC | 1055 | TGCAGGACCAGAGAATTCGAATACAGTATGTATNNNCTAGCGTTAC | 1295 |
| TGCAGGACCAGAGAATTCGAATACATTGATTGANNNCTAGCGTTAC | 816 | TGCAGGACCAGAGAATTCGAATACATTAGGCGTNNNCTAGCGTTAC | 1056 | TGCAGGACCAGAGAATTCGAATACAGCAGCAGGNNNCTAGCGTTAC | 1296 |
| TGCAGGACCAGAGAATTCGAATACATGCGACGCNNNCTAGCGTTAC | 817 | TGCAGGACCAGAGAATTCGAATACATCGGAGCCNNNCTAGCGTTAC | 1057 | TGCAGGACCAGAGAATTCGAATACAGCAGGTCCNNNCTAGCGTTAC | 1297 |
| TGCAGGACCAGAGAATTCGAATACAGTGGTTCANNNCTAGCGTTAC | 818 | TGCAGGACCAGAGAATTCGAATACAGTCTACAGNNNCTAGCGTTAC | 1058 | TGCAGGACCAGAGAATTCGAATACATGTAGGCTNNNCTAGCGTTAC | 1298 |
| TGCAGGACCAGAGAATTCGAATACAGCCGGCTANNNCTAGCGTTAC | 819 | TGCAGGACCAGAGAATTCGAATACACCGCGTCTNNNCTAGCGTTAC | 1059 | TGCAGGACCAGAGAATTCGAATACATAACGACCNNNCTAGCGTTAC | 1299 |
| TGCAGGACCAGAGAATTCGAATACACCTTGCGCNNNCTAGCGTTAC | 820 | TGCAGGACCAGAGAATTCGAATACATTAAACTGNNNCTAGCGTTAC | 1060 | TGCAGGACCAGAGAATTCGAATACACGATCGGCNNNCTAGCGTTAC | 1300 |
| TGCAGGACCAGAGAATTCGAATACAGGTAAGTGNNNCTAGCGTTAC | 821 | TGCAGGACCAGAGAATTCGAATACAATAAGAACNNNCTAGCGTTAC | 1061 | TGCAGGACCAGAGAATTCGAATACAGGCCAACGNNNCTAGCGTTAC | 1301 |
| TGCAGGACCAGAGAATTCGAATACAGTGTCCAANNNCTAGCGTTAC | 822 | TGCAGGACCAGAGAATTCGAATACAATCATGCGNNNCTAGCGTTAC | 1062 | TGCAGGACCAGAGAATTCGAATACAGACATAAANNNCTAGCGTTAC | 1302 |
| TGCAGGACCAGAGAATTCGAATACATGCACTGANNNCTAGCGTTAC | 823 | TGCAGGACCAGAGAATTCGAATACACCACTCAGNNNCTAGCGTTAC | 1063 | TGCAGGACCAGAGAATTCGAATACACGCACATANNNCTAGCGTTAC | 1303 |
| TGCAGGACCAGAGAATTCGAATACAGAAACTTTNNNCTAGCGTTAC | 824 | TGCAGGACCAGAGAATTCGAATACACTCGAGTANNNCTAGCGTTAC | 1064 | TGCAGGACCAGAGAATTCGAATACAGCCTAGGCNNNCTAGCGTTAC | 1304 |

FIG. 13D

| Pool-4 | SEQ ID NO: | Pool-5 | SEQ ID NO: | Pool-6 | SEQ ID NO: |
|---|---|---|---|---|---|
| TGCAGGACCAGAGAATTCGAATA CATGTGTAGCNNNCTAGCGTTAC | 825 | TGCAGGACCAGAGAATTCGAATA CACTTTGCCANNNCTAGCGTTAC | 1065 | TGCAGGACCAGAGAATTCGAATA CATCCGCAAANNNCTAGCGTTAC | 1305 |
| TGCAGGACCAGAGAATTCGAATA CATCTACCTGNNNCTAGCGTTAC | 826 | TGCAGGACCAGAGAATTCGAATA CAAATTCTGANNNCTAGCGTTAC | 1066 | TGCAGGACCAGAGAATTCGAATA CACTTATAGANNNCTAGCGTTAC | 1306 |
| TGCAGGACCAGAGAATTCGAATA CATCTCTTAANNNCTAGCGTTAC | 827 | TGCAGGACCAGAGAATTCGAATA CAGATCGCATNNNCTAGCGTTAC | 1067 | TGCAGGACCAGAGAATTCGAATA CACGGCGGAANNNCTAGCGTTAC | 1307 |
| TGCAGGACCAGAGAATTCGAATA CAATCGAATTNNNCTAGCGTTAC | 828 | TGCAGGACCAGAGAATTCGAATA CATGTGTTGGNNNCTAGCGTTAC | 1068 | TGCAGGACCAGAGAATTCGAATA CAGTAGCACTNNNCTAGCGTTAC | 1308 |
| TGCAGGACCAGAGAATTCGAATA CATTTTTGGTNNNCTAGCGTTAC | 829 | TGCAGGACCAGAGAATTCGAATA CAGTAACATTNNNCTAGCGTTAC | 1069 | TGCAGGACCAGAGAATTCGAATA CAGCTGTCAANNNCTAGCGTTAC | 1309 |
| TGCAGGACCAGAGAATTCGAATA CATCAGTCCTNNNCTAGCGTTAC | 830 | TGCAGGACCAGAGAATTCGAATA CAACGCATCANNNCTAGCGTTAC | 1070 | TGCAGGACCAGAGAATTCGAATA CAGTGCCAGCNNNCTAGCGTTAC | 1310 |
| TGCAGGACCAGAGAATTCGAATA CAGTGCACATNNNCTAGCGTTAC | 831 | TGCAGGACCAGAGAATTCGAATA CATAGGAAGCNNNCTAGCGTTAC | 1071 | TGCAGGACCAGAGAATTCGAATA CATTCATATCNNNCTAGCGTTAC | 1311 |
| TGCAGGACCAGAGAATTCGAATA CAGTAGAAGCNNNCTAGCGTTAC | 832 | TGCAGGACCAGAGAATTCGAATA CAGCAATGTCNNNCTAGCGTTAC | 1072 | TGCAGGACCAGAGAATTCGAATA CACCCATGCCNNNCTAGCGTTAC | 1312 |
| TGCAGGACCAGAGAATTCGAATA CACAGCATTGNNNCTAGCGTTAC | 833 | TGCAGGACCAGAGAATTCGAATA CAGCCGGCATNNNCTAGCGTTAC | 1073 | TGCAGGACCAGAGAATTCGAATA CATTAGTTGANNNCTAGCGTTAC | 1313 |
| TGCAGGACCAGAGAATTCGAATA CACGCCTAGGNNNCTAGCGTTAC | 834 | TGCAGGACCAGAGAATTCGAATA CACTGAGCGCNNNCTAGCGTTAC | 1074 | TGCAGGACCAGAGAATTCGAATA CAATCAGAAANNNCTAGCGTTAC | 1314 |
| TGCAGGACCAGAGAATTCGAATA CACAGTTTGGNNNCTAGCGTTAC | 835 | TGCAGGACCAGAGAATTCGAATA CACTGCCTACNNNCTAGCGTTAC | 1075 | TGCAGGACCAGAGAATTCGAATA CATTAGAACTNNNCTAGCGTTAC | 1315 |
| TGCAGGACCAGAGAATTCGAATA CATCCCAAGANNNCTAGCGTTAC | 836 | TGCAGGACCAGAGAATTCGAATA CAGTGCGGANNNCTAGCGTTAC | 1076 | TGCAGGACCAGAGAATTCGAATA CAGTGCTATGNNNCTAGCGTTAC | 1316 |
| TGCAGGACCAGAGAATTCGAATA CATTAGGACCNNNCTAGCGTTAC | 837 | TGCAGGACCAGAGAATTCGAATA CAAGGCTACTNNNCTAGCGTTAC | 1077 | TGCAGGACCAGAGAATTCGAATA CATTGGATCGNNNCTAGCGTTAC | 1317 |
| TGCAGGACCAGAGAATTCGAATA CAACAATTTGNNNCTAGCGTTAC | 838 | TGCAGGACCAGAGAATTCGAATA CAACTTTGTTNNNCTAGCGTTAC | 1078 | TGCAGGACCAGAGAATTCGAATA CACAAGAATANNNCTAGCGTTAC | 1318 |
| TGCAGGACCAGAGAATTCGAATA CATGCTCGAANNNCTAGCGTTAC | 839 | TGCAGGACCAGAGAATTCGAATA CAGCCATATGNNNCTAGCGTTAC | 1079 | TGCAGGACCAGAGAATTCGAATA CAAGCACCATNNNCTAGCGTTAC | 1319 |
| TGCAGGACCAGAGAATTCGAATA CAGGCGGTAGNNNCTAGCGTTAC | 840 | TGCAGGACCAGAGAATTCGAATA CAAGCCTGGCNNNCTAGCGTTAC | 1080 | TGCAGGACCAGAGAATTCGAATA CAACTAGACCNNNCTAGCGTTAC | 1320 |
| TGCAGGACCAGAGAATTCGAATA CAAATTAACCNNNCTAGCGTTAC | 841 | TGCAGGACCAGAGAATTCGAATA CAACGTGTGTNNNCTAGCGTTAC | 1081 | TGCAGGACCAGAGAATTCGAATA CAATCATTAGNNNCTAGCGTTAC | 1321 |
| TGCAGGACCAGAGAATTCGAATA CACGACACGNNNCTAGCGTTAC | 842 | TGCAGGACCAGAGAATTCGAATA CATTTTCATGNNNCTAGCGTTAC | 1082 | TGCAGGACCAGAGAATTCGAATA CAAGAACCTCNNNCTAGCGTTAC | 1322 |
| TGCAGGACCAGAGAATTCGAATA CAGTGAGGATNNNCTAGCGTTAC | 843 | TGCAGGACCAGAGAATTCGAATA CAGCTGCGACNNNCTAGCGTTAC | 1083 | TGCAGGACCAGAGAATTCGAATA CAGATTTTCTNNNCTAGCGTTAC | 1323 |
| TGCAGGACCAGAGAATTCGAATA CAAAATTAAANNNCTAGCGTTAC | 844 | TGCAGGACCAGAGAATTCGAATA CACAAAATAGNNNCTAGCGTTAC | 1084 | TGCAGGACCAGAGAATTCGAATA CAAGTACGGANNNCTAGCGTTAC | 1324 |
| TGCAGGACCAGAGAATTCGAATA CACATGCCAANNNCTAGCGTTAC | 845 | TGCAGGACCAGAGAATTCGAATA CACTAACTANNNCTAGCGTTAC | 1085 | TGCAGGACCAGAGAATTCGAATA CACGCCTAAANNNCTAGCGTTAC | 1325 |
| TGCAGGACCAGAGAATTCGAATA CACCATCAGANNNCTAGCGTTAC | 846 | TGCAGGACCAGAGAATTCGAATA CAAAATGATGNNNCTAGCGTTAC | 1086 | TGCAGGACCAGAGAATTCGAATA CAAGTTGGTCNNNCTAGCGTTAC | 1326 |
| TGCAGGACCAGAGAATTCGAATA CAATATAAANNNCTAGCGTTAC | 847 | TGCAGGACCAGAGAATTCGAATA CACTTGCTTGNNNCTAGCGTTAC | 1087 | TGCAGGACCAGAGAATTCGAATA CATGCGCACGNNNCTAGCGTTAC | 1327 |
| TGCAGGACCAGAGAATTCGAATA CAGCCTCCGTNNNCTAGCGTTAC | 848 | TGCAGGACCAGAGAATTCGAATA CAGATAGGCANNNCTAGCGTTAC | 1088 | TGCAGGACCAGAGAATTCGAATA CATTGGTACGNNNCTAGCGTTAC | 1328 |
| TGCAGGACCAGAGAATTCGAATA CATCCAATCCNNNGATCGACATG | 849 | TGCAGGACCAGAGAATTCGAATA CACAGATTATNNNGATCGACATG | 1089 | TGCAGGACCAGAGAATTCGAATA CAATGAGATANNNGATCGACATG | 1329 |
| TGCAGGACCAGAGAATTCGAATA CAAATGCCCNNNGATCGACATG | 850 | TGCAGGACCAGAGAATTCGAATA CAGTTACGGTNNNGATCGACATG | 1090 | TGCAGGACCAGAGAATTCGAATA CAATCGGTACNNNGATCGACATG | 1330 |
| TGCAGGACCAGAGAATTCGAATA CAACTGTCGANNNGATCGACATG | 851 | TGCAGGACCAGAGAATTCGAATA CAACAGTTGCNNNGATCGACATG | 1091 | TGCAGGACCAGAGAATTCGAATA CATGTCGTTCNNNGATCGACATG | 1331 |
| TGCAGGACCAGAGAATTCGAATA CAGCTGTTGANNNGATCGACATG | 852 | TGCAGGACCAGAGAATTCGAATA CAAACTGCACNNNGATCGACATG | 1092 | TGCAGGACCAGAGAATTCGAATA CATGTGTATANNNGATCGACATG | 1332 |
| TGCAGGACCAGAGAATTCGAATA CAGGTAACCTNNNGATCGACATG | 853 | TGCAGGACCAGAGAATTCGAATA CAAGAATATGNNNGATCGACATG | 1093 | TGCAGGACCAGAGAATTCGAATA CAGTGGATCTNNNGATCGACATG | 1333 |
| TGCAGGACCAGAGAATTCGAATA CACTTTTCCNNNGATCGACATG | 854 | TGCAGGACCAGAGAATTCGAATA CATCGTCCTANNNGATCGACATG | 1094 | TGCAGGACCAGAGAATTCGAATA CATCTTCAATNNNGATCGACATG | 1334 |
| TGCAGGACCAGAGAATTCGAATA CAGAGAGCCGNNNGATCGACATG | 855 | TGCAGGACCAGAGAATTCGAATA CACAGAACCNNNGATCGACATG | 1095 | TGCAGGACCAGAGAATTCGAATA CACGCGTGTGNNNGATCGACATG | 1335 |
| TGCAGGACCAGAGAATTCGAATA CACAGACAGANNNGATCGACATG | 856 | TGCAGGACCAGAGAATTCGAATA CACTTGACAGNNNGATCGACATG | 1096 | TGCAGGACCAGAGAATTCGAATA CACTCCTCGGNNNGATCGACATG | 1336 |

FIG. 13E

| Pool-4 | SEQ ID NO: | Pool-5 | SEQ ID NO: | Pool-6 | SEQ ID NO: |
|---|---|---|---|---|---|
| TGCAGGACCAGAGAATTCGAATA CATATATGACNNNGATCGACATG | 857 | TGCAGGACCAGAGAATTCGAATA CACTGGTAGTNNNGATCGACATG | 1097 | TGCAGGACCAGAGAATTCGAATA CAGACTAATTNNNGATCGACATG | 1337 |
| TGCAGGACCAGAGAATTCGAATA CAGTCCGACGNNNGATCGACATG | 858 | TGCAGGACCAGAGAATTCGAATA CACGGATCTANNNGATCGACATG | 1098 | TGCAGGACCAGAGAATTCGAATA CACAATAAGANNNGATCGACATG | 1338 |
| TGCAGGACCAGAGAATTCGAATA CAACTGCATGNNNGATCGACATG | 859 | TGCAGGACCAGAGAATTCGAATA CAAAAAAGAGNNNGATCGACATG | 1099 | TGCAGGACCAGAGAATTCGAATA CATTTACCGCNNNGATCGACATG | 1339 |
| TGCAGGACCAGAGAATTCGAATA CATACCTAAANNNGATCGACATG | 860 | TGCAGGACCAGAGAATTCGAATA CAGGAGACATNNNGATCGACATG | 1100 | TGCAGGACCAGAGAATTCGAATA CAGTGTATTANNNGATCGACATG | 1340 |
| TGCAGGACCAGAGAATTCGAATA CAACCAGATCNNNGATCGACATG | 861 | TGCAGGACCAGAGAATTCGAATA CATCGGAGCNNNGATCGACATG | 1101 | TGCAGGACCAGAGAATTCGAATA CAAGATGTAANNNGATCGACATG | 1341 |
| TGCAGGACCAGAGAATTCGAATA CAGGCAAATGNNNGATCGACATG | 862 | TGCAGGACCAGAGAATTCGAATA CATGTTATTCNNNGATCGACATG | 1102 | TGCAGGACCAGAGAATTCGAATA CATTATTCGTNNNGATCGACATG | 1342 |
| TGCAGGACCAGAGAATTCGAATA CAGAACGTCTNNNGATCGACATG | 863 | TGCAGGACCAGAGAATTCGAATA CAGCGAGACGNNNGATCGACATG | 1103 | TGCAGGACCAGAGAATTCGAATA CAAGTCACACNNNGATCGACATG | 1343 |
| TGCAGGACCAGAGAATTCGAATA CACCACCAAANNNGATCGACATG | 864 | TGCAGGACCAGAGAATTCGAATA CATTATCGAANNNGATCGACATG | 1104 | TGCAGGACCAGAGAATTCGAATA CACTGACAACNNNGATCGACATG | 1344 |
| TGCAGGACCAGAGAATTCGAATA CATTTTCCAANNNGATCGACATG | 865 | TGCAGGACCAGAGAATTCGAATA CAGTGCCAATNNNGATCGACATG | 1105 | TGCAGGACCAGAGAATTCGAATA CAACGCGGTNNNGATCGACATG | 1345 |
| TGCAGGACCAGAGAATTCGAATA CAGTTAGTTANNNGATCGACATG | 866 | TGCAGGACCAGAGAATTCGAATA CAGCTAAAANNNGATCGACATG | 1106 | TGCAGGACCAGAGAATTCGAATA CAGGTGACCCNNNGATCGACATG | 1346 |
| TGCAGGACCAGAGAATTCGAATA CATCAGCTCTNNNGATCGACATG | 867 | TGCAGGACCAGAGAATTCGAATA CAATCCAATANNNGATCGACATG | 1107 | TGCAGGACCAGAGAATTCGAATA CACCTTAGCTNNNGATCGACATG | 1347 |
| TGCAGGACCAGAGAATTCGAATA CATGCGGAGGNNNGATCGACATG | 868 | TGCAGGACCAGAGAATTCGAATA CATTCAAGGCNNNGATCGACATG | 1108 | TGCAGGACCAGAGAATTCGAATA CACTCGCTATNNNGATCGACATG | 1348 |
| TGCAGGACCAGAGAATTCGAATA CATCTGCAAGNNNGATCGACATG | 869 | TGCAGGACCAGAGAATTCGAATA CATTATTAAANNNGATCGACATG | 1109 | TGCAGGACCAGAGAATTCGAATA CAAGCCTAGTNNNGATCGACATG | 1349 |
| TGCAGGACCAGAGAATTCGAATA CATCTAACCCNNNGATCGACATG | 870 | TGCAGGACCAGAGAATTCGAATA CAAACTCTAANNNGATCGACATG | 1110 | TGCAGGACCAGAGAATTCGAATA CAGAGAGTTGNNNGATCGACATG | 1350 |
| TGCAGGACCAGAGAATTCGAATA CACGTAGGAANNNGATCGACATG | 871 | TGCAGGACCAGAGAATTCGAATA CAGACTCCAANNNGATCGACATG | 1111 | TGCAGGACCAGAGAATTCGAATA CATAAGAGGCNNNGATCGACATG | 1351 |
| TGCAGGACCAGAGAATTCGAATA CACAAGACTCNNNGATCGACATG | 872 | TGCAGGACCAGAGAATTCGAATA CACAGCCTCNNNGATCGACATG | 1112 | TGCAGGACCAGAGAATTCGAATA CAGTTAATACNNNGATCGACATG | 1352 |
| TGCAGGACCAGAGAATTCGAATA CATTCCGTGTNNNGATCGACATG | 873 | TGCAGGACCAGAGAATTCGAATA CAGAGTCACTNNNGATCGACATG | 1113 | TGCAGGACCAGAGAATTCGAATA CAGGTCCGCANNNGATCGACATG | 1353 |
| TGCAGGACCAGAGAATTCGAATA CAGTGAACGANNNGATCGACATG | 874 | TGCAGGACCAGAGAATTCGAATA CAAGAACTGGNNNGATCGACATG | 1114 | TGCAGGACCAGAGAATTCGAATA CATAAGCATTNNNGATCGACATG | 1354 |
| TGCAGGACCAGAGAATTCGAATA CAGCTAAACCNNNGATCGACATG | 875 | TGCAGGACCAGAGAATTCGAATA CAGCGTATTGNNNGATCGACATG | 1115 | TGCAGGACCAGAGAATTCGAATA CAGTACGCATNNNGATCGACATG | 1355 |
| TGCAGGACCAGAGAATTCGAATA CACAATTTTCNNNGATCGACATG | 876 | TGCAGGACCAGAGAATTCGAATA CACTTAAATGNNNGATCGACATG | 1116 | TGCAGGACCAGAGAATTCGAATA CAAACGAACGNNNGATCGACATG | 1356 |
| TGCAGGACCAGAGAATTCGAATA CATGAGGAACNNNGATCGACATG | 877 | TGCAGGACCAGAGAATTCGAATA CATTAGCCTCNNNGATCGACATG | 1117 | TGCAGGACCAGAGAATTCGAATA CAGTAGGTTCNNNGATCGACATG | 1357 |
| TGCAGGACCAGAGAATTCGAATA CAGTAATCTANNNGATCGACATG | 878 | TGCAGGACCAGAGAATTCGAATA CAACCAGAGANNNGATCGACATG | 1118 | TGCAGGACCAGAGAATTCGAATA CACTTTTTTCNNNGATCGACATG | 1358 |
| TGCAGGACCAGAGAATTCGAATA CATATCTCCGNNNGATCGACATG | 879 | TGCAGGACCAGAGAATTCGAATA CATCAGCCAANNNGATCGACATG | 1119 | TGCAGGACCAGAGAATTCGAATA CAATGACCCANNNGATCGACATG | 1359 |
| TGCAGGACCAGAGAATTCGAATA CAGCTACGGCNNNGATCGACATG | 880 | TGCAGGACCAGAGAATTCGAATA CACCGAATACNNNGATCGACATG | 1120 | TGCAGGACCAGAGAATTCGAATA CAATCAGTTANNNGATCGACATG | 1360 |
| TGCAGGACCAGAGAATTCGAATA CAATATCTGANNNGATCGACATG | 881 | TGCAGGACCAGAGAATTCGAATA CAGCGGCAAGNNNGATCGACATG | 1121 | TGCAGGACCAGAGAATTCGAATA CATAGTAAAGNNNGATCGACATG | 1361 |
| TGCAGGACCAGAGAATTCGAATA CATACTTAGANNNGATCGACATG | 882 | TGCAGGACCAGAGAATTCGAATA CATAAATCGTNNNGATCGACATG | 1122 | TGCAGGACCAGAGAATTCGAATA CACCCGATGNNNGATCGACATG | 1362 |
| TGCAGGACCAGAGAATTCGAATA CATCATTTTGNNNGATCGACATG | 883 | TGCAGGACCAGAGAATTCGAATA CAAGCTTCGNNNGATCGACATG | 1123 | TGCAGGACCAGAGAATTCGAATA CACACAGCATNNNGATCGACATG | 1363 |
| TGCAGGACCAGAGAATTCGAATA CAGCGTGGAGNNNGATCGACATG | 884 | TGCAGGACCAGAGAATTCGAATA CAATGCATATNNNGATCGACATG | 1124 | TGCAGGACCAGAGAATTCGAATA CACAGGTACTNNNGATCGACATG | 1364 |
| TGCAGGACCAGAGAATTCGAATA CATAAGACGGNNNGATCGACATG | 885 | TGCAGGACCAGAGAATTCGAATA CATCTCTCCTNNNGATCGACATG | 1125 | TGCAGGACCAGAGAATTCGAATA CACATAACCGNNNGATCGACATG | 1365 |
| TGCAGGACCAGAGAATTCGAATA CAAGGCCTTANNNGATCGACATG | 886 | TGCAGGACCAGAGAATTCGAATA CATAGTGGTCNNNGATCGACATG | 1126 | TGCAGGACCAGAGAATTCGAATA CAGTACTGGTNNNGATCGACATG | 1366 |
| TGCAGGACCAGAGAATTCGAATA CACATCTCACNNNGATCGACATG | 887 | TGCAGGACCAGAGAATTCGAATA CAGAAACCTCNNNGATCGACATG | 1127 | TGCAGGACCAGAGAATTCGAATA CAGCAAGTCTNNNGATCGACATG | 1367 |
| TGCAGGACCAGAGAATTCGAATA CATGCCGATCANNNGATCGACATG | 888 | TGCAGGACCAGAGAATTCGAATA CATGACTATANNNGATCGACATG | 1128 | TGCAGGACCAGAGAATTCGAATA CACGTGCTCCNNNGATCGACATG | 1368 |

FIG. 13F

| Pool-4 | SEQ ID NO: | Pool-5 | SEQ ID NO: | Pool-6 | SEQ ID NO: |
|---|---|---|---|---|---|
| TGCAGGACCAGAGAATTCGAATACACGGAGGACNNNGATCGACATG | 889 | TGCAGGACCAGAGAATTCGAATACACATGACTGNNNGATCGACATG | 1129 | TGCAGGACCAGAGAATTCGAATACACACTACCTNNNGATCGACATG | 1369 |
| TGCAGGACCAGAGAATTCGAATACAACTAATTGNNNGATCGACATG | 890 | TGCAGGACCAGAGAATTCGAATACACCAAAGTCNNNGATCGACATG | 1130 | TGCAGGACCAGAGAATTCGAATACAGTGTATATNNNGATCGACATG | 1370 |
| TGCAGGACCAGAGAATTCGAATACATGCCTAGANNNGATCGACATG | 891 | TGCAGGACCAGAGAATTCGAATACACGCATTCNNNGATCGACATG | 1131 | TGCAGGACCAGAGAATTCGAATACAATGACGCTNNNGATCGACATG | 1371 |
| TGCAGGACCAGAGAATTCGAATACACTATCCGTNNNGATCGACATG | 892 | TGCAGGACCAGAGAATTCGAATACAACCCGGTGNNNGATCGACATG | 1132 | TGCAGGACCAGAGAATTCGAATACAAGGCACTTNNNGATCGACATG | 1372 |
| TGCAGGACCAGAGAATTCGAATACATGCCAGGCNNNGATCGACATG | 893 | TGCAGGACCAGAGAATTCGAATACACTTGCGTTNNNGATCGACATG | 1133 | TGCAGGACCAGAGAATTCGAATACAGGCAGGCANNNGATCGACATG | 1373 |
| TGCAGGACCAGAGAATTCGAATACAGCGGAGCANNNGATCGACATG | 894 | TGCAGGACCAGAGAATTCGAATACATTATGCAANNNGATCGACATG | 1134 | TGCAGGACCAGAGAATTCGAATACACTATGTTTNNNGATCGACATG | 1374 |
| TGCAGGACCAGAGAATTCGAATACAAGACCCATNNNGATCGACATG | 895 | TGCAGGACCAGAGAATTCGAATACATATTTGAGNNNGATCGACATG | 1135 | TGCAGGACCAGAGAATTCGAATACATAAATATTNNNGATCGACATG | 1375 |
| TGCAGGACCAGAGAATTCGAATACATTGACCTCNNNGATCGACATG | 896 | TGCAGGACCAGAGAATTCGAATACATGTTCGCTNNNGATCGACATG | 1136 | TGCAGGACCAGAGAATTCGAATACAGACACCATNNNGATCGACATG | 1376 |
| TGCAGGACCAGAGAATTCGAATACACTTGCTCANNNGATCGACATG | 897 | TGCAGGACCAGAGAATTCGAATACATAGCATCGNNNGATCGACATG | 1137 | TGCAGGACCAGAGAATTCGAATACATAGATACTNNNGATCGACATG | 1377 |
| TGCAGGACCAGAGAATTCGAATACAATGCTGCANNNGATCGACATG | 898 | TGCAGGACCAGAGAATTCGAATACATTCAGAGCNNNGATCGACATG | 1138 | TGCAGGACCAGAGAATTCGAATACATACCCTGTNNNGATCGACATG | 1378 |
| TGCAGGACCAGAGAATTCGAATACAAACGGACANNNGATCGACATG | 899 | TGCAGGACCAGAGAATTCGAATACAAACGCGAGNNNGATCGACATG | 1139 | TGCAGGACCAGAGAATTCGAATACAGTCGCCGANNNGATCGACATG | 1379 |
| TGCAGGACCAGAGAATTCGAATACAGCGATCATNNNGATCGACATG | 900 | TGCAGGACCAGAGAATTCGAATACATATGCCGTNNNGATCGACATG | 1140 | TGCAGGACCAGAGAATTCGAATACACCTCTTAGNNNGATCGACATG | 1380 |
| TGCAGGACCAGAGAATTCGAATACATGACAGCAGNNNGATCGACATG | 901 | TGCAGGACCAGAGAATTCGAATACAAGCCTATGNNNGATCGACATG | 1141 | TGCAGGACCAGAGAATTCGAATACATAAGATTCNNNGATCGACATG | 1381 |
| TGCAGGACCAGAGAATTCGAATACAGCCACTGGNNNGATCGACATG | 902 | TGCAGGACCAGAGAATTCGAATACACACTCTACNNNGATCGACATG | 1142 | TGCAGGACCAGAGAATTCGAATACACGCGTACGNNNGATCGACATG | 1382 |
| TGCAGGACCAGAGAATTCGAATACAGGTTTGACNNNGATCGACATG | 903 | TGCAGGACCAGAGAATTCGAATACAAAACTGAANNNGATCGACATG | 1143 | TGCAGGACCAGAGAATTCGAATACACTGACCAANNNGATCGACATG | 1383 |
| TGCAGGACCAGAGAATTCGAATACAAACTTGGCNNNGATCGACATG | 904 | TGCAGGACCAGAGAATTCGAATACACTTCCGCGNNNGATCGACATG | 1144 | TGCAGGACCAGAGAATTCGAATACAAAGACCGANNNGATCGACATG | 1384 |
| TGCAGGACCAGAGAATTCGAATACAACCTAATANNNGATCGACATG | 905 | TGCAGGACCAGAGAATTCGAATACAACGTCGGCNNNGATCGACATG | 1145 | TGCAGGACCAGAGAATTCGAATACAAATGATTCNNNGATCGACATG | 1385 |
| TGCAGGACCAGAGAATTCGAATACAGCACAANNNGATCGACATG | 906 | TGCAGGACCAGAGAATTCGAATACAGTACCAANNNGATCGACATG | 1146 | TGCAGGACCAGAGAATTCGAATACACCCCCCANNNGATCGACATG | 1386 |
| TGCAGGACCAGAGAATTCGAATACATGTGTCAGNNNGATCGACATG | 907 | TGCAGGACCAGAGAATTCGAATACAACCGCATANNNGATCGACATG | 1147 | TGCAGGACCAGAGAATTCGAATACAGCCTGAATNNNGATCGACATG | 1387 |
| TGCAGGACCAGAGAATTCGAATACAAGTAACAANNNGATCGACATG | 908 | TGCAGGACCAGAGAATTCGAATACAAACCAGCTNNNGATCGACATG | 1148 | TGCAGGACCAGAGAATTCGAATACATCGGTAGTNNNGATCGACATG | 1388 |
| TGCAGGACCAGAGAATTCGAATACATCTGAGCANNNTGCATCAGGT | 909 | TGCAGGACCAGAGAATTCGAATACAGAGCCAGCNNNTGCATCAGGT | 1149 | TGCAGGACCAGAGAATTCGAATACATGGCTCGGNNNTGCATCAGGT | 1389 |
| TGCAGGACCAGAGAATTCGAATACAAGTGAACNNNTGCATCAGGT | 910 | TGCAGGACCAGAGAATTCGAATACATTTTATTANNNTGCATCAGGT | 1150 | TGCAGGACCAGAGAATTCGAATACACAATCCTCNNNTGCATCAGGT | 1390 |
| TGCAGGACCAGAGAATTCGAATACAGAACTCGTNNNTGCATCAGGT | 911 | TGCAGGACCAGAGAATTCGAATACAGCTAGGTTNNNTGCATCAGGT | 1151 | TGCAGGACCAGAGAATTCGAATACATAGAGACGNNNTGCATCAGGT | 1391 |
| TGCAGGACCAGAGAATTCGAATACAGCAGGCGANNNTGCATCAGGT | 912 | TGCAGGACCAGAGAATTCGAATACATTTGACTTNNNTGCATCAGGT | 1152 | TGCAGGACCAGAGAATTCGAATACAGCGGATGGNNNTGCATCAGGT | 1392 |
| TGCAGGACCAGAGAATTCGAATACAGGCTCTCCNNNTGCATCAGGT | 913 | TGCAGGACCAGAGAATTCGAATACACAAACATTNNNTGCATCAGGT | 1153 | TGCAGGACCAGAGAATTCGAATACACTCACCATNNNTGCATCAGGT | 1393 |
| TGCAGGACCAGAGAATTCGAATACAAATACATCNNNTGCATCAGGT | 914 | TGCAGGACCAGAGAATTCGAATACATTGCAATANNNTGCATCAGGT | 1154 | TGCAGGACCAGAGAATTCGAATACAATGGTAAANNNTGCATCAGGT | 1394 |
| TGCAGGACCAGAGAATTCGAATACAAGGTCAAGNNNTGCATCAGGT | 915 | TGCAGGACCAGAGAATTCGAATACAACAAGGCANNNTGCATCAGGT | 1155 | TGCAGGACCAGAGAATTCGAATACATATCAACANNNTGCATCAGGT | 1395 |
| TGCAGGACCAGAGAATTCGAATACATGAGCCGCNNNTGCATCAGGT | 916 | TGCAGGACCAGAGAATTCGAATACAGGTGCTGCNNNTGCATCAGGT | 1156 | TGCAGGACCAGAGAATTCGAATACAAAAGTCAANNNTGCATCAGGT | 1396 |
| TGCAGGACCAGAGAATTCGAATACATTAGTTTCNNNTGCATCAGGT | 917 | TGCAGGACCAGAGAATTCGAATACAAGGTCGTTNNNTGCATCAGGT | 1157 | TGCAGGACCAGAGAATTCGAATACACAAAGGCANNNTGCATCAGGT | 1397 |
| TGCAGGACCAGAGAATTCGAATACAGTCGTAGTNNNTGCATCAGGT | 918 | TGCAGGACCAGAGAATTCGAATACACAACGGAANNNTGCATCAGGT | 1158 | TGCAGGACCAGAGAATTCGAATACACGATGACTNNNTGCATCAGGT | 1398 |
| TGCAGGACCAGAGAATTCGAATACAAAAGGATTNNNTGCATCAGGT | 919 | TGCAGGACCAGAGAATTCGAATACAGATCCAATNNNTGCATCAGGT | 1159 | TGCAGGACCAGAGAATTCGAATACACGATTGTGNNNTGCATCAGGT | 1399 |
| TGCAGGACCAGAGAATTCGAATACATTTTTAGCNNNTGCATCAGGT | 920 | TGCAGGACCAGAGAATTCGAATACAGGAAGACTNNNTGCATCAGGT | 1160 | TGCAGGACCAGAGAATTCGAATACATTATCTTGNNNTGCATCAGGT | 1400 |

FIG. 13G

| Pool-4 | SEQ ID NO: | Pool-5 | SEQ ID NO: | Pool-6 | SEQ ID NO: |
|---|---|---|---|---|---|
| TGCAGGACCAGAGAATTCGAATACAATAACTCANNNTGCATCAGGT | 921 | TGCAGGACCAGAGAATTCGAATACAGGTAAATANNNTGCATCAGGT | 1161 | TGCAGGACCAGAGAATTCGAATACAGTATTGATNNNTGCATCAGGT | 1401 |
| TGCAGGACCAGAGAATTCGAATACATTTTAACCNNNTGCATCAGGT | 922 | TGCAGGACCAGAGAATTCGAATACAGGTAGAACNNNTGCATCAGGT | 1162 | TGCAGGACCAGAGAATTCGAATACAAGGAGGTTNNNTGCATCAGGT | 1402 |
| TGCAGGACCAGAGAATTCGAATACAGTGCCGACNNNTGCATCAGGT | 923 | TGCAGGACCAGAGAATTCGAATACAATATGAGANNNTGCATCAGGT | 1163 | TGCAGGACCAGAGAATTCGAATACAACTGCCCCNNNTGCATCAGGT | 1403 |
| TGCAGGACCAGAGAATTCGAATACAGAATAGATNNNTGCATCAGGT | 924 | TGCAGGACCAGAGAATTCGAATACATGGAAATANNNTGCATCAGGT | 1164 | TGCAGGACCAGAGAATTCGAATACAAAATCTCANNNTGCATCAGGT | 1404 |
| TGCAGGACCAGAGAATTCGAATACAGCTGAGCCNNNTGCATCAGGT | 925 | TGCAGGACCAGAGAATTCGAATACATAACCAATNNNTGCATCAGGT | 1165 | TGCAGGACCAGAGAATTCGAATACACCATGTGANNNTGCATCAGGT | 1405 |
| TGCAGGACCAGAGAATTCGAATACAACAGGCAANNNTGCATCAGGT | 926 | TGCAGGACCAGAGAATTCGAATACAGTCTGATGNNNTGCATCAGGT | 1166 | TGCAGGACCAGAGAATTCGAATACACCCCTTTTNNNTGCATCAGGT | 1406 |
| TGCAGGACCAGAGAATTCGAATACAGACCGCACNNNTGCATCAGGT | 927 | TGCAGGACCAGAGAATTCGAATACATTTATGAGNNNTGCATCAGGT | 1167 | TGCAGGACCAGAGAATTCGAATACAGCTAGCGCNNNTGCATCAGGT | 1407 |
| TGCAGGACCAGAGAATTCGAATACACTTATTCANNNTGCATCAGGT | 928 | TGCAGGACCAGAGAATTCGAATACAATGATTTGNNNTGCATCAGGT | 1168 | TGCAGGACCAGAGAATTCGAATACAAACACCCNNNTGCATCAGGT | 1408 |
| TGCAGGACCAGAGAATTCGAATACAGTGTGCTANNNTGCATCAGGT | 929 | TGCAGGACCAGAGAATTCGAATACACTCATCGTNNNTGCATCAGGT | 1169 | TGCAGGACCAGAGAATTCGAATACACTGAGATCNNNTGCATCAGGT | 1409 |
| TGCAGGACCAGAGAATTCGAATACAATTTAGTGNNNTGCATCAGGT | 930 | TGCAGGACCAGAGAATTCGAATACACTCCATACNNNTGCATCAGGT | 1170 | TGCAGGACCAGAGAATTCGAATACAAATGCGTCNNNTGCATCAGGT | 1410 |
| TGCAGGACCAGAGAATTCGAATACATCGGAGAANNNTGCATCAGGT | 931 | TGCAGGACCAGAGAATTCGAATACAGCTACATNNNTGCATCAGGT | 1171 | TGCAGGACCAGAGAATTCGAATACAATTGCCAGNNNTGCATCAGGT | 1411 |
| TGCAGGACCAGAGAATTCGAATACACGCCGAACNNNTGCATCAGGT | 932 | TGCAGGACCAGAGAATTCGAATACAAATCATCANNNTGCATCAGGT | 1172 | TGCAGGACCAGAGAATTCGAATACATTAATTCCNNNTGCATCAGGT | 1412 |
| TGCAGGACCAGAGAATTCGAATACAGCTTCGCCNNNTGCATCAGGT | 933 | TGCAGGACCAGAGAATTCGAATACACGTCTCATNNNTGCATCAGGT | 1173 | TGCAGGACCAGAGAATTCGAATACAAGCATATTNNNTGCATCAGGT | 1413 |
| TGCAGGACCAGAGAATTCGAATACAACAATCATNNNTGCATCAGGT | 934 | TGCAGGACCAGAGAATTCGAATACAACTCGTTCNNNTGCATCAGGT | 1174 | TGCAGGACCAGAGAATTCGAATACACCCATTACNNNTGCATCAGGT | 1414 |
| TGCAGGACCAGAGAATTCGAATACATGATCGCANNNTGCATCAGGT | 935 | TGCAGGACCAGAGAATTCGAATACAAGTTCTGGNNNTGCATCAGGT | 1175 | TGCAGGACCAGAGAATTCGAATACACTCGTTTGNNNTGCATCAGGT | 1415 |
| TGCAGGACCAGAGAATTCGAATACACACAGTACNNNTGCATCAGGT | 936 | TGCAGGACCAGAGAATTCGAATACAACTAGTATNNNTGCATCAGGT | 1176 | TGCAGGACCAGAGAATTCGAATACAGGTATCGTNNNTGCATCAGGT | 1416 |
| TGCAGGACCAGAGAATTCGAATACAGTCAAGTCNNNTGCATCAGGT | 937 | TGCAGGACCAGAGAATTCGAATACAATTGCGCANNNTGCATCAGGT | 1177 | TGCAGGACCAGAGAATTCGAATACAGTACCCTTNNNTGCATCAGGT | 1417 |
| TGCAGGACCAGAGAATTCGAATACAGCTCCCACNNNTGCATCAGGT | 938 | TGCAGGACCAGAGAATTCGAATACACGAGCGCTNNNTGCATCAGGT | 1178 | TGCAGGACCAGAGAATTCGAATACACAACTTTTNNNTGCATCAGGT | 1418 |
| TGCAGGACCAGAGAATTCGAATACATTACTTGTNNNTGCATCAGGT | 939 | TGCAGGACCAGAGAATTCGAATACAACGACCATNNNTGCATCAGGT | 1179 | TGCAGGACCAGAGAATTCGAATACAGAACTTGCNNNTGCATCAGGT | 1419 |
| TGCAGGACCAGAGAATTCGAATACATAATGTGTNNNTGCATCAGGT | 940 | TGCAGGACCAGAGAATTCGAATACATAAGTGAANNNTGCATCAGGT | 1180 | TGCAGGACCAGAGAATTCGAATACATATTATGGNNNTGCATCAGGT | 1420 |
| TGCAGGACCAGAGAATTCGAATACATACCATTTNNNTGCATCAGGT | 941 | TGCAGGACCAGAGAATTCGAATACATCTGCCGGNNNTGCATCAGGT | 1181 | TGCAGGACCAGAGAATTCGAATACAGCCCGCGNNNTGCATCAGGT | 1421 |
| TGCAGGACCAGAGAATTCGAATACAGTCCGTAANNNTGCATCAGGT | 942 | TGCAGGACCAGAGAATTCGAATACAAATACTGTNNNTGCATCAGGT | 1182 | TGCAGGACCAGAGAATTCGAATACAGCAAAAGCNNNTGCATCAGGT | 1422 |
| TGCAGGACCAGAGAATTCGAATACAAGCGGTAANNNTGCATCAGGT | 943 | TGCAGGACCAGAGAATTCGAATACATATGTTCTNNNTGCATCAGGT | 1183 | TGCAGGACCAGAGAATTCGAATACAGATACGCTNNNTGCATCAGGT | 1423 |
| TGCAGGACCAGAGAATTCGAATACAGGAAACTGNNNTGCATCAGGT | 944 | TGCAGGACCAGAGAATTCGAATACACCAGCGGTNNNTGCATCAGGT | 1184 | TGCAGGACCAGAGAATTCGAATACACAGTATCGNNNTGCATCAGGT | 1424 |
| TGCAGGACCAGAGAATTCGAATACAGGCCACGTNNNTGCATCAGGT | 945 | TGCAGGACCAGAGAATTCGAATACACGGTTGATNNNTGCATCAGGT | 1185 | TGCAGGACCAGAGAATTCGAATACACTCACTGTNNNTGCATCAGGT | 1425 |
| TGCAGGACCAGAGAATTCGAATACATCATTGAANNNTGCATCAGGT | 946 | TGCAGGACCAGAGAATTCGAATACACGCGTGCANNNTGCATCAGGT | 1186 | TGCAGGACCAGAGAATTCGAATACACCCGTCAGGNNNTGCATCAGGT | 1426 |
| TGCAGGACCAGAGAATTCGAATACAGCGTCAATNNNTGCATCAGGT | 947 | TGCAGGACCAGAGAATTCGAATACAGTCTAAATNNNTGCATCAGGT | 1187 | TGCAGGACCAGAGAATTCGAATACAGCTTCTGTNNNTGCATCAGGT | 1427 |
| TGCAGGACCAGAGAATTCGAATACACGGAAGCGNNNTGCATCAGGT | 948 | TGCAGGACCAGAGAATTCGAATACAGTAATTACNNNTGCATCAGGT | 1188 | TGCAGGACCAGAGAATTCGAATACATTATATTTNNNTGCATCAGGT | 1428 |
| TGCAGGACCAGAGAATTCGAATACAGTTCGAACNNNTGCATCAGGT | 949 | TGCAGGACCAGAGAATTCGAATACATTCCGGTTNNNTGCATCAGGT | 1189 | TGCAGGACCAGAGAATTCGAATACAGGTTTACGNNNTGCATCAGGT | 1429 |
| TGCAGGACCAGAGAATTCGAATACAGGCCCCTTNNNTGCATCAGGT | 950 | TGCAGGACCAGAGAATTCGAATACAGAGCGTGGNNNTGCATCAGGT | 1190 | TGCAGGACCAGAGAATTCGAATACAGGACGATANNNTGCATCAGGT | 1430 |
| TGCAGGACCAGAGAATTCGAATACAATGGCTCANNNTGCATCAGGT | 951 | TGCAGGACCAGAGAATTCGAATACAATTTACTCNNNTGCATCAGGT | 1191 | TGCAGGACCAGAGAATTCGAATACAAGTCAGGANNNTGCATCAGGT | 1431 |
| TGCAGGACCAGAGAATTCGAATACATTGACGGTNNNTGCATCAGGT | 952 | TGCAGGACCAGAGAATTCGAATACACAACACTGNNNTGCATCAGGT | 1192 | TGCAGGACCAGAGAATTCGAATACACTACGAACNNNTGCATCAGGT | 1432 |

FIG. 13H

| Pool-4 | SEQ ID NO: | Pool-5 | SEQ ID NO: | Pool-6 | SEQ ID NO: |
|---|---|---|---|---|---|
| TGCAGGACCAGAGAATTCGAATA CATGGACGTTNNNTGCATCAGGT | 953 | TGCAGGACCAGAGAATTCGAATA CACCGCGGCGNNNTGCATCAGGT | 1193 | TGCAGGACCAGAGAATTCGAATA CAAGCCATGTNNNTGCATCAGGT | 1433 |
| TGCAGGACCAGAGAATTCGAATA CATGACAGTCNNNTGCATCAGGT | 954 | TGCAGGACCAGAGAATTCGAATA CACTAAGCTGNNNTGCATCAGGT | 1194 | TGCAGGACCAGAGAATTCGAATA CATTCCACTGNNNTGCATCAGGT | 1434 |
| TGCAGGACCAGAGAATTCGAATA CACTACCTGTNNNTGCATCAGGT | 955 | TGCAGGACCAGAGAATTCGAATA CAATTCAAGTNNNTGCATCAGGT | 1195 | TGCAGGACCAGAGAATTCGAATA CAACCCTGTTNNNTGCATCAGGT | 1435 |
| TGCAGGACCAGAGAATTCGAATA CAAGGTCCCGNNNTGCATCAGGT | 956 | TGCAGGACCAGAGAATTCGAATA CAATTGGCGTNNNTGCATCAGGT | 1196 | TGCAGGACCAGAGAATTCGAATA CACCCTTTCTNNNTGCATCAGGT | 1436 |
| TGCAGGACCAGAGAATTCGAATA CATTCATCTANNNTGCATCAGGT | 957 | TGCAGGACCAGAGAATTCGAATA CATGATTTGANNNTGCATCAGGT | 1197 | TGCAGGACCAGAGAATTCGAATA CAATGTTGATNNNTGCATCAGGT | 1437 |
| TGCAGGACCAGAGAATTCGAATA CAGATAAAGTNNNTGCATCAGGT | 958 | TGCAGGACCAGAGAATTCGAATA CAACTGCCGGNNNTGCATCAGGT | 1198 | TGCAGGACCAGAGAATTCGAATA CACACTGGCGNNNTGCATCAGGT | 1438 |
| TGCAGGACCAGAGAATTCGAATA CACACGGAAANNNTGCATCAGGT | 959 | TGCAGGACCAGAGAATTCGAATA CATTAATCCTNNNTGCATCAGGT | 1199 | TGCAGGACCAGAGAATTCGAATA CATTCGGTAGNNNTGCATCAGGT | 1439 |
| TGCAGGACCAGAGAATTCGAATA CATGTGAGGANNNTGCATCAGGT | 960 | TGCAGGACCAGAGAATTCGAATA CACTACGCTTNNNTGCATCAGGT | 1200 | TGCAGGACCAGAGAATTCGAATA CAACCCTGCCNNNTGCATCAGGT | 1440 |
| TGCAGGACCAGAGAATTCGAATA CACGTGATCANNNTGCATCAGGT | 961 | TGCAGGACCAGAGAATTCGAATA CATAGCTATANNNTGCATCAGGT | 1201 | TGCAGGACCAGAGAATTCGAATA CAGTACCTAGNNNTGCATCAGGT | 1441 |
| TGCAGGACCAGAGAATTCGAATA CATGCGTTGANNNTGCATCAGGT | 962 | TGCAGGACCAGAGAATTCGAATA CATGCACTCTNNNTGCATCAGGT | 1202 | TGCAGGACCAGAGAATTCGAATA CACGATAATTNNNTGCATCAGGT | 1442 |
| TGCAGGACCAGAGAATTCGAATA CATCGCTCCGNNNTGCATCAGGT | 963 | TGCAGGACCAGAGAATTCGAATA CAGTGCTCCCNNNTGCATCAGGT | 1203 | TGCAGGACCAGAGAATTCGAATA CAGCCAACCGNNNTGCATCAGGT | 1443 |
| TGCAGGACCAGAGAATTCGAATA CACCAGTCAANNNTGCATCAGGT | 964 | TGCAGGACCAGAGAATTCGAATA CAGCCACCAGNNNTGCATCAGGT | 1204 | TGCAGGACCAGAGAATTCGAATA CATAACATCANNNTGCATCAGGT | 1444 |
| TGCAGGACCAGAGAATTCGAATA CACACATTCCNNNTGCATCAGGT | 965 | TGCAGGACCAGAGAATTCGAATA CATTATGTGANNNTGCATCAGGT | 1205 | TGCAGGACCAGAGAATTCGAATA CAGCAAGAACNNNTGCATCAGGT | 1445 |
| TGCAGGACCAGAGAATTCGAATA CAGGTATATTNNNTGCATCAGGT | 966 | TGCAGGACCAGAGAATTCGAATA CAATACTCCCNNNTGCATCAGGT | 1206 | TGCAGGACCAGAGAATTCGAATA CAACGTGATCNNNTGCATCAGGT | 1446 |
| TGCAGGACCAGAGAATTCGAATA CATAAGATGANNNTGCATCAGGT | 967 | TGCAGGACCAGAGAATTCGAATA CAACTATGGCNNNTGCATCAGGT | 1207 | TGCAGGACCAGAGAATTCGAATA CACGTTCCTANNNTGCATCAGGT | 1447 |
| TGCAGGACCAGAGAATTCGAATA CATTAAAATTNNNTGCATCAGGT | 968 | TGCAGGACCAGAGAATTCGAATA CAACGGCCTGNNNTGCATCAGGT | 1208 | TGCAGGACCAGAGAATTCGAATA CAATGCCAGTNNNTGCATCAGGT | 1448 |

FIG. 14A

| Pool-7 | SEQ ID NO: | Pool-8 | SEQ ID NO: | Pool-9 | SEQ ID NO: |
|---|---|---|---|---|---|
| TGCAGGACCAGAGAATTCGAATA CACAGGCTCGNNNACGTATGCCA | 1449 | TGCAGGACCAGAGAATTCGAATA CAACTACCAGNNNACGTATGCCA | 1689 | TGCAGGACCAGAGAATTCGAATA CAGAACGCCCNNNACGTATGCCA | 1929 |
| TGCAGGACCAGAGAATTCGAATA CATTGAAGCCNNNACGTATGCCA | 1450 | TGCAGGACCAGAGAATTCGAATA CATTATTGAGNNNACGTATGCCA | 1690 | TGCAGGACCAGAGAATTCGAATA CAACCAATGCNNNACGTATGCCA | 1930 |
| TGCAGGACCAGAGAATTCGAATA CACACAGAGANNNACGTATGCCA | 1451 | TGCAGGACCAGAGAATTCGAATA CAACTGTGTGNNNACGTATGCCA | 1691 | TGCAGGACCAGAGAATTCGAATA CAGACCGATTNNNACGTATGCCA | 1931 |
| TGCAGGACCAGAGAATTCGAATA CAGGACTCCGNNNACGTATGCCA | 1452 | TGCAGGACCAGAGAATTCGAATA CATTGATCGGNNNACGTATGCCA | 1692 | TGCAGGACCAGAGAATTCGAATA CAATGTTATGNNNACGTATGCCA | 1932 |
| TGCAGGACCAGAGAATTCGAATA CATTGGTTAANNNACGTATGCCA | 1453 | TGCAGGACCAGAGAATTCGAATA CATTCTCGGTNNNACGTATGCCA | 1693 | TGCAGGACCAGAGAATTCGAATA CAGGAAGAAGNNNACGTATGCCA | 1933 |
| TGCAGGACCAGAGAATTCGAATA CATACTAACANNNACGTATGCCA | 1454 | TGCAGGACCAGAGAATTCGAATA CACCAGTTAGNNNACGTATGCCA | 1694 | TGCAGGACCAGAGAATTCGAATA CAGTTATACANNNACGTATGCCA | 1934 |
| TGCAGGACCAGAGAATTCGAATA CAGTCCAATGNNNACGTATGCCA | 1455 | TGCAGGACCAGAGAATTCGAATA CAAGAACAATNNNACGTATGCCA | 1695 | TGCAGGACCAGAGAATTCGAATA CACCTCCTAANNNACGTATGCCA | 1935 |
| TGCAGGACCAGAGAATTCGAATA CAAGGCACGGNNNACGTATGCCA | 1456 | TGCAGGACCAGAGAATTCGAATA CATCCGAAGTNNNACGTATGCCA | 1696 | TGCAGGACCAGAGAATTCGAATA CATAAACATCNNNACGTATGCCA | 1936 |
| TGCAGGACCAGAGAATTCGAATA CAATCATGTANNNACGTATGCCA | 1457 | TGCAGGACCAGAGAATTCGAATA CATCGGCTCCNNNACGTATGCCA | 1697 | TGCAGGACCAGAGAATTCGAATA CACGGCGGTTNNNACGTATGCCA | 1937 |
| TGCAGGACCAGAGAATTCGAATA CAAAAAGGTTNNNACGTATGCCA | 1458 | TGCAGGACCAGAGAATTCGAATA CACAGTCCCCNNNACGTATGCCA | 1698 | TGCAGGACCAGAGAATTCGAATA CATTAACAACNNNACGTATGCCA | 1938 |
| TGCAGGACCAGAGAATTCGAATA CAAGGCACCCNNNACGTATGCCA | 1459 | TGCAGGACCAGAGAATTCGAATA CAGTCAACTGNNNACGTATGCCA | 1699 | TGCAGGACCAGAGAATTCGAATA CATGGCCATANNNACGTATGCCA | 1939 |
| TGCAGGACCAGAGAATTCGAATA CATTGAAAGANNNACGTATGCCA | 1460 | TGCAGGACCAGAGAATTCGAATA CAGGCGGCTTNNNACGTATGCCA | 1700 | TGCAGGACCAGAGAATTCGAATA CAGAGTCATGNNNACGTATGCCA | 1940 |
| TGCAGGACCAGAGAATTCGAATA CACTCGACTTNNNACGTATGCCA | 1461 | TGCAGGACCAGAGAATTCGAATA CAATGCGCTANNNACGTATGCCA | 1701 | TGCAGGACCAGAGAATTCGAATA CACTAATGCGNNNACGTATGCCA | 1941 |
| TGCAGGACCAGAGAATTCGAATA CAGCGAATTCNNNACGTATGCCA | 1462 | TGCAGGACCAGAGAATTCGAATA CAGCTCCGANNNACGTATGCCA | 1702 | TGCAGGACCAGAGAATTCGAATA CAAGGTTAAANNNACGTATGCCA | 1942 |
| TGCAGGACCAGAGAATTCGAATA CACCCCCGCGNNNACGTATGCCA | 1463 | TGCAGGACCAGAGAATTCGAATA CATGCTGGCGNNNACGTATGCCA | 1703 | TGCAGGACCAGAGAATTCGAATA CAACAGTACCNNNACGTATGCCA | 1943 |
| TGCAGGACCAGAGAATTCGAATA CAGATAAGCGNNNACGTATGCCA | 1464 | TGCAGGACCAGAGAATTCGAATA CACTAACGTGNNNACGTATGCCA | 1704 | TGCAGGACCAGAGAATTCGAATA CAATGTGATTNNNACGTATGCCA | 1944 |
| TGCAGGACCAGAGAATTCGAATA CAGAACGATGNNNACGTATGCCA | 1465 | TGCAGGACCAGAGAATTCGAATA CAGAATACAANNNACGTATGCCA | 1705 | TGCAGGACCAGAGAATTCGAATA CAGCTGCCGANNNACGTATGCCA | 1945 |
| TGCAGGACCAGAGAATTCGAATA CAAATATTATNNNACGTATGCCA | 1466 | TGCAGGACCAGAGAATTCGAATA CAATGACAAANNNACGTATGCCA | 1706 | TGCAGGACCAGAGAATTCGAATA CACTTTTTAGNNNACGTATGCCA | 1946 |
| TGCAGGACCAGAGAATTCGAATA CATAAGCTATNNNACGTATGCCA | 1467 | TGCAGGACCAGAGAATTCGAATA CAACGGCTCGNNNACGTATGCCA | 1707 | TGCAGGACCAGAGAATTCGAATA CATCCCAAAGNNNACGTATGCCA | 1947 |
| TGCAGGACCAGAGAATTCGAATA CAACTCGGCGNNNACGTATGCCA | 1468 | TGCAGGACCAGAGAATTCGAATA CAACAGATAANNNACGTATGCCA | 1708 | TGCAGGACCAGAGAATTCGAATA CAGACACTACNNNACGTATGCCA | 1948 |
| TGCAGGACCAGAGAATTCGAATA CACGACTGCGNNNACGTATGCCA | 1469 | TGCAGGACCAGAGAATTCGAATA CATGTAGCCANNNACGTATGCCA | 1709 | TGCAGGACCAGAGAATTCGAATA CAATACCGACNNNACGTATGCCA | 1949 |
| TGCAGGACCAGAGAATTCGAATA CATCCGACTTNNNACGTATGCCA | 1470 | TGCAGGACCAGAGAATTCGAATA CACTTCTGCANNNACGTATGCCA | 1710 | TGCAGGACCAGAGAATTCGAATA CAGTTGAAAANNNACGTATGCCA | 1950 |
| TGCAGGACCAGAGAATTCGAATA CAGGAGGAGGNNNACGTATGCCA | 1471 | TGCAGGACCAGAGAATTCGAATA CATTACCTTANNNACGTATGCCA | 1711 | TGCAGGACCAGAGAATTCGAATA CAATTCCTATNNNACGTATGCCA | 1951 |
| TGCAGGACCAGAGAATTCGAATA CACAGGCAGGNNNACGTATGCCA | 1472 | TGCAGGACCAGAGAATTCGAATA CATCAATTCTNNNACGTATGCCA | 1712 | TGCAGGACCAGAGAATTCGAATA CAACGTTCAGNNNACGTATGCCA | 1952 |
| TGCAGGACCAGAGAATTCGAATA CAATCTCATTNNNACGTATGCCA | 1473 | TGCAGGACCAGAGAATTCGAATA CAAGGTTCGTNNNACGTATGCCA | 1713 | TGCAGGACCAGAGAATTCGAATA CAAATACGAANNNACGTATGCCA | 1953 |
| TGCAGGACCAGAGAATTCGAATA CAAGGCGATANNNACGTATGCCA | 1474 | TGCAGGACCAGAGAATTCGAATA CAATTTTAAANNNACGTATGCCA | 1714 | TGCAGGACCAGAGAATTCGAATA CACCAACTGANNNACGTATGCCA | 1954 |
| TGCAGGACCAGAGAATTCGAATA CACCTAGATGNNNACGTATGCCA | 1475 | TGCAGGACCAGAGAATTCGAATA CATTGCAGACNNNACGTATGCCA | 1715 | TGCAGGACCAGAGAATTCGAATA CAATCCGTCTNNNACGTATGCCA | 1955 |
| TGCAGGACCAGAGAATTCGAATA CACCTACCATNNNACGTATGCCA | 1476 | TGCAGGACCAGAGAATTCGAATA CACCCACTGNNNACGTATGCCA | 1716 | TGCAGGACCAGAGAATTCGAATA CACGTCCGCTNNNACGTATGCCA | 1956 |

FIG. 14B

| Pool-7 | SEQ ID NO: | Pool-8 | SEQ ID NO: | Pool-9 | SEQ ID NO: |
|---|---|---|---|---|---|
| TGCAGGACCAGAGAATTCGAATA CAAACGTCCANNNACGTATGCCA | 1477 | TGCAGGACCAGAGAATTCGAATA CACTTCCTGANNNACGTATGCCA | 1717 | TGCAGGACCAGAGAATTCGAATA CATATACACANNNACGTATGCCA | 1957 |
| TGCAGGACCAGAGAATTCGAATA CAGCACTTAGNNNACGTATGCCA | 1478 | TGCAGGACCAGAGAATTCGAATA CAAGAACTCCNNNACGTATGCCA | 1718 | TGCAGGACCAGAGAATTCGAATA CACTCTATATNNNACGTATGCCA | 1958 |
| TGCAGGACCAGAGAATTCGAATA CAGATCGGAANNNACGTATGCCA | 1479 | TGCAGGACCAGAGAATTCGAATA CACTGTAAGCNNNACGTATGCCA | 1719 | TGCAGGACCAGAGAATTCGAATA CACTCACAGANNNACGTATGCCA | 1959 |
| TGCAGGACCAGAGAATTCGAATA CACGCCATAANNNACGTATGCCA | 1480 | TGCAGGACCAGAGAATTCGAATA CAAGTCGATCNNNACGTATGCCA | 1720 | TGCAGGACCAGAGAATTCGAATA CAGCCGGTGTNNNACGTATGCCA | 1960 |
| TGCAGGACCAGAGAATTCGAATA CATTAAGTTGNNNACGTATGCCA | 1481 | TGCAGGACCAGAGAATTCGAATA CAGTAATAGANNNACGTATGCCA | 1721 | TGCAGGACCAGAGAATTCGAATA CATACGTCAGNNNACGTATGCCA | 1961 |
| TGCAGGACCAGAGAATTCGAATA CAGCCAGCTGNNNACGTATGCCA | 1482 | TGCAGGACCAGAGAATTCGAATA CACGGAGCTCNNNACGTATGCCA | 1722 | TGCAGGACCAGAGAATTCGAATA CATCTGCTCANNNACGTATGCCA | 1962 |
| TGCAGGACCAGAGAATTCGAATA CAAAACGCCTNNNACGTATGCCA | 1483 | TGCAGGACCAGAGAATTCGAATA CATTGTCTTANNNACGTATGCCA | 1723 | TGCAGGACCAGAGAATTCGAATA CAACGTATATNNNACGTATGCCA | 1963 |
| TGCAGGACCAGAGAATTCGAATA CAGTATTTCTNNNACGTATGCCA | 1484 | TGCAGGACCAGAGAATTCGAATA CATTTCGTANNNACGTATGCCA | 1724 | TGCAGGACCAGAGAATTCGAATA CACGAGCCACNNNACGTATGCCA | 1964 |
| TGCAGGACCAGAGAATTCGAATA CAGGTCTCCCNNNACGTATGCCA | 1485 | TGCAGGACCAGAGAATTCGAATA CAAACGGAACNNNACGTATGCCA | 1725 | TGCAGGACCAGAGAATTCGAATA CATCGCTCTANNNACGTATGCCA | 1965 |
| TGCAGGACCAGAGAATTCGAATA CACAAGTCTGNNNACGTATGCCA | 1486 | TGCAGGACCAGAGAATTCGAATA CAACCACGGCNNNACGTATGCCA | 1726 | TGCAGGACCAGAGAATTCGAATA CACGGAAGATNNNACGTATGCCA | 1966 |
| TGCAGGACCAGAGAATTCGAATA CAGAGCACAANNNACGTATGCCA | 1487 | TGCAGGACCAGAGAATTCGAATA CAGAGTATTTNNNACGTATGCCA | 1727 | TGCAGGACCAGAGAATTCGAATA CATTAGCGGTNNNACGTATGCCA | 1967 |
| TGCAGGACCAGAGAATTCGAATA CATCAAACCGNNNACGTATGCCA | 1488 | TGCAGGACCAGAGAATTCGAATA CACCCGCCTANNNACGTATGCCA | 1728 | TGCAGGACCAGAGAATTCGAATA CATGAGCTCANNNACGTATGCCA | 1968 |
| TGCAGGACCAGAGAATTCGAATA CATTCCGCTANNNACGTATGCCA | 1489 | TGCAGGACCAGAGAATTCGAATA CAAGTATGCCNNNACGTATGCCA | 1729 | TGCAGGACCAGAGAATTCGAATA CATACACGTGNNNACGTATGCCA | 1969 |
| TGCAGGACCAGAGAATTCGAATA CAATTCACGNNNACGTATGCCA | 1490 | TGCAGGACCAGAGAATTCGAATA CATAGCAGCTNNNACGTATGCCA | 1730 | TGCAGGACCAGAGAATTCGAATA CATAGTGTATNNNACGTATGCCA | 1970 |
| TGCAGGACCAGAGAATTCGAATA CAATACCTAANNNACGTATGCCA | 1491 | TGCAGGACCAGAGAATTCGAATA CACGCGTGACNNNACGTATGCCA | 1731 | TGCAGGACCAGAGAATTCGAATA CACATTAGGCNNNACGTATGCCA | 1971 |
| TGCAGGACCAGAGAATTCGAATA CAGGACCGGANNNACGTATGCCA | 1492 | TGCAGGACCAGAGAATTCGAATA CAAAATACGANNNACGTATGCCA | 1732 | TGCAGGACCAGAGAATTCGAATA CAACACCACANNNACGTATGCCA | 1972 |
| TGCAGGACCAGAGAATTCGAATA CATGTCCCGCNNNACGTATGCCA | 1493 | TGCAGGACCAGAGAATTCGAATA CACTAGATATNNNACGTATGCCA | 1733 | TGCAGGACCAGAGAATTCGAATA CAGTGCGTCGNNNACGTATGCCA | 1973 |
| TGCAGGACCAGAGAATTCGAATA CAGCCCCAGANNNACGTATGCCA | 1494 | TGCAGGACCAGAGAATTCGAATA CAATGTTGGCNNNACGTATGCCA | 1734 | TGCAGGACCAGAGAATTCGAATA CATATGTTTCNNNACGTATGCCA | 1974 |
| TGCAGGACCAGAGAATTCGAATA CACAAGCCCGNNNACGTATGCCA | 1495 | TGCAGGACCAGAGAATTCGAATA CACTACGCAANNNACGTATGCCA | 1735 | TGCAGGACCAGAGAATTCGAATA CAGTGGTCGCNNNACGTATGCCA | 1975 |
| TGCAGGACCAGAGAATTCGAATA CAGCCATTGANNNACGTATGCCA | 1496 | TGCAGGACCAGAGAATTCGAATA CATTTCTGTANNNACGTATGCCA | 1736 | TGCAGGACCAGAGAATTCGAATA CACTGGACCGNNNACGTATGCCA | 1976 |
| TGCAGGACCAGAGAATTCGAATA CATGAACACCNNNACGTATGCCA | 1497 | TGCAGGACCAGAGAATTCGAATA CACCTCCCTCNNNACGTATGCCA | 1737 | TGCAGGACCAGAGAATTCGAATA CAGGCGTGTCNNNACGTATGCCA | 1977 |
| TGCAGGACCAGAGAATTCGAATA CAGAATCCGTNNNACGTATGCCA | 1498 | TGCAGGACCAGAGAATTCGAATA CAGACTTGACNNNACGTATGCCA | 1738 | TGCAGGACCAGAGAATTCGAATA CAAGTCTAATNNNACGTATGCCA | 1978 |
| TGCAGGACCAGAGAATTCGAATA CATTAATCGANNNACGTATGCCA | 1499 | TGCAGGACCAGAGAATTCGAATA CAGTCATCGANNNACGTATGCCA | 1739 | TGCAGGACCAGAGAATTCGAATA CACTCATGCTNNNACGTATGCCA | 1979 |
| TGCAGGACCAGAGAATTCGAATA CACGCCACTCNNNACGTATGCCA | 1500 | TGCAGGACCAGAGAATTCGAATA CAATCTAGTANNNACGTATGCCA | 1740 | TGCAGGACCAGAGAATTCGAATA CAAGTTCTCCNNNACGTATGCCA | 1980 |
| TGCAGGACCAGAGAATTCGAATA CACCCTTAGTNNNACGTATGCCA | 1501 | TGCAGGACCAGAGAATTCGAATA CACGAAGATGNNNACGTATGCCA | 1741 | TGCAGGACCAGAGAATTCGAATA CAGTGAAGGTNNNACGTATGCCA | 1981 |
| TGCAGGACCAGAGAATTCGAATA CATTCCTGGNNNACGTATGCCA | 1502 | TGCAGGACCAGAGAATTCGAATA CAATTTGCAANNNACGTATGCCA | 1742 | TGCAGGACCAGAGAATTCGAATA CAGTTTTAAGNNNACGTATGCCA | 1982 |
| TGCAGGACCAGAGAATTCGAATA CATTCAACGNNNACGTATGCCA | 1503 | TGCAGGACCAGAGAATTCGAATA CAGACCGGCTNNNACGTATGCCA | 1743 | TGCAGGACCAGAGAATTCGAATA CAAAAGCAATNNNACGTATGCCA | 1983 |
| TGCAGGACCAGAGAATTCGAATA CATTGAGGAGNNNACGTATGCCA | 1504 | TGCAGGACCAGAGAATTCGAATA CACTTGTCACNNNACGTATGCCA | 1744 | TGCAGGACCAGAGAATTCGAATA CATGAAGCGANNNACGTATGCCA | 1984 |
| TGCAGGACCAGAGAATTCGAATA CATTCACGGCTNNNACGTATGCCA | 1505 | TGCAGGACCAGAGAATTCGAATA CACTCGTAAGNNNACGTATGCCA | 1745 | TGCAGGACCAGAGAATTCGAATA CAGTAGTGCTNNNACGTATGCCA | 1985 |

FIG. 14C

| Pool-7 | SEQ ID NO: | Pool-8 | SEQ ID NO: | Pool-9 | SEQ ID NO: |
|---|---|---|---|---|---|
| TGCAGGACCAGAGAATTCGAATACATCGCGGTGNNNACGTATGCCA | 1506 | TGCAGGACCAGAGAATTCGAATACAGCCTTACTNNNACGTATGCCA | 1746 | TGCAGGACCAGAGAATTCGAATACAACTATGTANNNACGTATGCCA | 1986 |
| TGCAGGACCAGAGAATTCGAATACAAATTCCGGNNNACGTATGCCA | 1507 | TGCAGGACCAGAGAATTCGAATACAGCATGTGTNNNACGTATGCCA | 1747 | TGCAGGACCAGAGAATTCGAATACAGAAGTTCCNNNACGTATGCCA | 1987 |
| TGCAGGACCAGAGAATTCGAATACACGTCATGANNNACGTATGCCA | 1508 | TGCAGGACCAGAGAATTCGAATACACTACTGTCNNNACGTATGCCA | 1748 | TGCAGGACCAGAGAATTCGAATACACGGTGCTGNNNACGTATGCCA | 1988 |
| TGCAGGACCAGAGAATTCGAATACACGTTTATTNNNCTAGCGTTAC | 1509 | TGCAGGACCAGAGAATTCGAATACAATCTAACANNNCTAGCGTTAC | 1749 | TGCAGGACCAGAGAATTCGAATACATGCAAATTNNNCTAGCGTTAC | 1989 |
| TGCAGGACCAGAGAATTCGAATACACTGCACGGNNNCTAGCGTTAC | 1510 | TGCAGGACCAGAGAATTCGAATACAACGATTGGNNNCTAGCGTTAC | 1750 | TGCAGGACCAGAGAATTCGAATACAACTTGTGGNNNCTAGCGTTAC | 1990 |
| TGCAGGACCAGAGAATTCGAATACAACCTTGTCNNNCTAGCGTTAC | 1511 | TGCAGGACCAGAGAATTCGAATACAAAACCTTANNNCTAGCGTTAC | 1751 | TGCAGGACCAGAGAATTCGAATACATCGCTGCCNNNCTAGCGTTAC | 1991 |
| TGCAGGACCAGAGAATTCGAATACATCCACCCGNNNCTAGCGTTAC | 1512 | TGCAGGACCAGAGAATTCGAATACACGTAAAAANNNCTAGCGTTAC | 1752 | TGCAGGACCAGAGAATTCGAATACATCCCTTCTNNNCTAGCGTTAC | 1992 |
| TGCAGGACCAGAGAATTCGAATACAAAGGCCGGNNNCTAGCGTTAC | 1513 | TGCAGGACCAGAGAATTCGAATACATCTGAGACNNNCTAGCGTTAC | 1753 | TGCAGGACCAGAGAATTCGAATACACGGTACTANNNCTAGCGTTAC | 1993 |
| TGCAGGACCAGAGAATTCGAATACAGGCAATAGNNNCTAGCGTTAC | 1514 | TGCAGGACCAGAGAATTCGAATACATGGCGATTNNNCTAGCGTTAC | 1754 | TGCAGGACCAGAGAATTCGAATACAAGATATCNNNCTAGCGTTAC | 1994 |
| TGCAGGACCAGAGAATTCGAATACACGGTAGCGNNNCTAGCGTTAC | 1515 | TGCAGGACCAGAGAATTCGAATACACATCTTGCNNNCTAGCGTTAC | 1755 | TGCAGGACCAGAGAATTCGAATACACTCAAGTGNNNCTAGCGTTAC | 1995 |
| TGCAGGACCAGAGAATTCGAATACATGTTCTATNNNCTAGCGTTAC | 1516 | TGCAGGACCAGAGAATTCGAATACATCTTTCGGNNNCTAGCGTTAC | 1756 | TGCAGGACCAGAGAATTCGAATACAACCTCCTANNNCTAGCGTTAC | 1996 |
| TGCAGGACCAGAGAATTCGAATACATTAATATANNNCTAGCGTTAC | 1517 | TGCAGGACCAGAGAATTCGAATACAGCGAACANNNCTAGCGTTAC | 1757 | TGCAGGACCAGAGAATTCGAATACAAGCAATTNNNCTAGCGTTAC | 1997 |
| TGCAGGACCAGAGAATTCGAATACAATATGGTTNNNCTAGCGTTAC | 1518 | TGCAGGACCAGAGAATTCGAATACAGAGTAGACNNNCTAGCGTTAC | 1758 | TGCAGGACCAGAGAATTCGAATACAGCCCCGAANNNCTAGCGTTAC | 1998 |
| TGCAGGACCAGAGAATTCGAATACAGCTGGTTANNNCTAGCGTTAC | 1519 | TGCAGGACCAGAGAATTCGAATACACTCATGGANNNCTAGCGTTAC | 1759 | TGCAGGACCAGAGAATTCGAATACACCAAATCGNNNCTAGCGTTAC | 1999 |
| TGCAGGACCAGAGAATTCGAATACAAGACTGAGNNNCTAGCGTTAC | 1520 | TGCAGGACCAGAGAATTCGAATACATTCCCGGCNNNCTAGCGTTAC | 1760 | TGCAGGACCAGAGAATTCGAATACAGATCGGTTNNNCTAGCGTTAC | 2000 |
| TGCAGGACCAGAGAATTCGAATACAGACTTGCANNNCTAGCGTTAC | 1521 | TGCAGGACCAGAGAATTCGAATACATGGCCTAANNNCTAGCGTTAC | 1761 | TGCAGGACCAGAGAATTCGAATACAACCCCTGCNNNCTAGCGTTAC | 2001 |
| TGCAGGACCAGAGAATTCGAATACAGTCTATCCNNNCTAGCGTTAC | 1522 | TGCAGGACCAGAGAATTCGAATACAAGCGCAAANNNCTAGCGTTAC | 1762 | TGCAGGACCAGAGAATTCGAATACAACCCACTNNNCTAGCGTTAC | 2002 |
| TGCAGGACCAGAGAATTCGAATACAAGCTATCGNNNCTAGCGTTAC | 1523 | TGCAGGACCAGAGAATTCGAATACAATAGAAACNNNCTAGCGTTAC | 1763 | TGCAGGACCAGAGAATTCGAATACAAGACCTTGNNNCTAGCGTTAC | 2003 |
| TGCAGGACCAGAGAATTCGAATACAGGCGAACGNNNCTAGCGTTAC | 1524 | TGCAGGACCAGAGAATTCGAATACATCGGCTGGNNNCTAGCGTTAC | 1764 | TGCAGGACCAGAGAATTCGAATACACCTTGATCNNNCTAGCGTTAC | 2004 |
| TGCAGGACCAGAGAATTCGAATACAACGAATGGNNNCTAGCGTTAC | 1525 | TGCAGGACCAGAGAATTCGAATACAGTGCTCGGNNNCTAGCGTTAC | 1765 | TGCAGGACCAGAGAATTCGAATACAAAGTATTCNNNCTAGCGTTAC | 2005 |
| TGCAGGACCAGAGAATTCGAATACATCATGCTCNNNCTAGCGTTAC | 1526 | TGCAGGACCAGAGAATTCGAATACAAATGCCACNNNCTAGCGTTAC | 1766 | TGCAGGACCAGAGAATTCGAATACACATCCAAGNNNCTAGCGTTAC | 2006 |
| TGCAGGACCAGAGAATTCGAATACATTGCTTATNNNCTAGCGTTAC | 1527 | TGCAGGACCAGAGAATTCGAATACAATCACGTGNNNCTAGCGTTAC | 1767 | TGCAGGACCAGAGAATTCGAATACACACAAGTCNNNCTAGCGTTAC | 2007 |
| TGCAGGACCAGAGAATTCGAATACAAAGCCAGANNNCTAGCGTTAC | 1528 | TGCAGGACCAGAGAATTCGAATACATCACGACANNNCTAGCGTTAC | 1768 | TGCAGGACCAGAGAATTCGAATACATAAAATGNNNCTAGCGTTAC | 2008 |
| TGCAGGACCAGAGAATTCGAATACAGCAGCTCGNNNCTAGCGTTAC | 1529 | TGCAGGACCAGAGAATTCGAATACATGTTACGNNNCTAGCGTTAC | 1769 | TGCAGGACCAGAGAATTCGAATACAATCTACAANNNCTAGCGTTAC | 2009 |
| TGCAGGACCAGAGAATTCGAATACACCGAGTCGNNNCTAGCGTTAC | 1530 | TGCAGGACCAGAGAATTCGAATACATTACCGCTNNNCTAGCGTTAC | 1770 | TGCAGGACCAGAGAATTCGAATACAGCGAGAATNNNCTAGCGTTAC | 2010 |
| TGCAGGACCAGAGAATTCGAATACAAACAGACGNNNCTAGCGTTAC | 1531 | TGCAGGACCAGAGAATTCGAATACACCCTTTAGNNNCTAGCGTTAC | 1771 | TGCAGGACCAGAGAATTCGAATACAGTAGCCATNNNCTAGCGTTAC | 2011 |
| TGCAGGACCAGAGAATTCGAATACACCCAAACANNNCTAGCGTTAC | 1532 | TGCAGGACCAGAGAATTCGAATACAGTCTTGAGNNNCTAGCGTTAC | 1772 | TGCAGGACCAGAGAATTCGAATACAAAGGCAGTNNNCTAGCGTTAC | 2012 |
| TGCAGGACCAGAGAATTCGAATACAAAGGCGATNNNCTAGCGTTAC | 1533 | TGCAGGACCAGAGAATTCGAATACACTTTGACCNNNCTAGCGTTAC | 1773 | TGCAGGACCAGAGAATTCGAATACAGTAGACTCNNNCTAGCGTTAC | 2013 |
| TGCAGGACCAGAGAATTCGAATACACCTTAAAANNNCTAGCGTTAC | 1534 | TGCAGGACCAGAGAATTCGAATACACTTCTCAGNNNCTAGCGTTAC | 1774 | TGCAGGACCAGAGAATTCGAATACAGGTATGCTNNNCTAGCGTTAC | 2014 |

FIG. 14D

| Pool-7 | SEQ ID NO: | Pool-8 | SEQ ID NO: | Pool-9 | SEQ ID NO: |
|---|---|---|---|---|---|
| TGCAGGACCAGAGAATTCGAATA CACATACCTCNNNCTAGCGTTAC | 1535 | TGCAGGACCAGAGAATTCGAATA CATGTTGCAGNNNCTAGCGTTAC | 1775 | TGCAGGACCAGAGAATTCGAATA CAGGTTTTAANNNCTAGCGTTAC | 2015 |
| TGCAGGACCAGAGAATTCGAATA CAGCCAATCANNNCTAGCGTTAC | 1536 | TGCAGGACCAGAGAATTCGAATA CAAACCCAACNNNCTAGCGTTAC | 1776 | TGCAGGACCAGAGAATTCGAATA CAACAGAAGCNNNCTAGCGTTAC | 2016 |
| TGCAGGACCAGAGAATTCGAATA CACTTAGGCANNNCTAGCGTTAC | 1537 | TGCAGGACCAGAGAATTCGAATA CATAAGCACCNNNCTAGCGTTAC | 1777 | TGCAGGACCAGAGAATTCGAATA CACAGCACGCNNNCTAGCGTTAC | 2017 |
| TGCAGGACCAGAGAATTCGAATA CACGCACCAGNNNCTAGCGTTAC | 1538 | TGCAGGACCAGAGAATTCGAATA CAGATGTAAANNNCTAGCGTTAC | 1778 | TGCAGGACCAGAGAATTCGAATA CAACCGTAACNNNCTAGCGTTAC | 2018 |
| TGCAGGACCAGAGAATTCGAATA CATTCCCGTANNNCTAGCGTTAC | 1539 | TGCAGGACCAGAGAATTCGAATA CAGTTATGCGNNNCTAGCGTTAC | 1779 | TGCAGGACCAGAGAATTCGAATA CAGGAAGCCGNNNCTAGCGTTAC | 2019 |
| TGCAGGACCAGAGAATTCGAATA CATTCAGAATNNNCTAGCGTTAC | 1540 | TGCAGGACCAGAGAATTCGAATA CAGCGCGGAANNNCTAGCGTTAC | 1780 | TGCAGGACCAGAGAATTCGAATA CAGAGGATCANNNCTAGCGTTAC | 2020 |
| TGCAGGACCAGAGAATTCGAATA CAGGCATTACNNNCTAGCGTTAC | 1541 | TGCAGGACCAGAGAATTCGAATA CAAGATTTGTNNNCTAGCGTTAC | 1781 | TGCAGGACCAGAGAATTCGAATA CACGGTTCGGNNNCTAGCGTTAC | 2021 |
| TGCAGGACCAGAGAATTCGAATA CAAACCAAABNNNCTAGCGTTAC | 1542 | TGCAGGACCAGAGAATTCGAATA CACACAGCTANNNCTAGCGTTAC | 1782 | TGCAGGACCAGAGAATTCGAATA CAATCCACAGNNNCTAGCGTTAC | 2022 |
| TGCAGGACCAGAGAATTCGAATA CAACGCTGTANNNCTAGCGTTAC | 1543 | TGCAGGACCAGAGAATTCGAATA CAACGCAGGNNNNCTAGCGTTAC | 1783 | TGCAGGACCAGAGAATTCGAATA CAGAGACCCCNNNCTAGCGTTAC | 2023 |
| TGCAGGACCAGAGAATTCGAATA CAACGATCTGNNNCTAGCGTTAC | 1544 | TGCAGGACCAGAGAATTCGAATA CATACGAAGNNNNCTAGCGTTAC | 1784 | TGCAGGACCAGAGAATTCGAATA CACTCCGGAGNNNCTAGCGTTAC | 2024 |
| TGCAGGACCAGAGAATTCGAATA CAGCATGAGANNNCTAGCGTTAC | 1545 | TGCAGGACCAGAGAATTCGAATA CACTCGATGANNNCTAGCGTTAC | 1785 | TGCAGGACCAGAGAATTCGAATA CATGCCTCGNNNNCTAGCGTTAC | 2025 |
| TGCAGGACCAGAGAATTCGAATA CAGTAAGTCCNNNCTAGCGTTAC | 1546 | TGCAGGACCAGAGAATTCGAATA CATCCCCCTNNNNCTAGCGTTAC | 1786 | TGCAGGACCAGAGAATTCGAATA CATCATTCCGNNNCTAGCGTTAC | 2026 |
| TGCAGGACCAGAGAATTCGAATA CAAAGCGAGTNNNCTAGCGTTAC | 1547 | TGCAGGACCAGAGAATTCGAATA CACCATCTACNNNCTAGCGTTAC | 1787 | TGCAGGACCAGAGAATTCGAATA CAGAACTACCNNNCTAGCGTTAC | 2027 |
| TGCAGGACCAGAGAATTCGAATA CAAGATCTGNNNNCTAGCGTTAC | 1548 | TGCAGGACCAGAGAATTCGAATA CAAAGCAGGTNNNCTAGCGTTAC | 1788 | TGCAGGACCAGAGAATTCGAATA CATAATTTTTNNNCTAGCGTTAC | 2028 |
| TGCAGGACCAGAGAATTCGAATA CACCCGTCACNNNCTAGCGTTAC | 1549 | TGCAGGACCAGAGAATTCGAATA CAAAGTCAAANNNCTAGCGTTAC | 1789 | TGCAGGACCAGAGAATTCGAATA CAGATTGTGCNNNCTAGCGTTAC | 2029 |
| TGCAGGACCAGAGAATTCGAATA CATCCTCGCGNNNCTAGCGTTAC | 1550 | TGCAGGACCAGAGAATTCGAATA CAATTCGACNNNNCTAGCGTTAC | 1790 | TGCAGGACCAGAGAATTCGAATA CATGGCGCACNNNCTAGCGTTAC | 2030 |
| TGCAGGACCAGAGAATTCGAATA CACATGTCGANNNCTAGCGTTAC | 1551 | TGCAGGACCAGAGAATTCGAATA CAACCAGCCGNNNCTAGCGTTAC | 1791 | TGCAGGACCAGAGAATTCGAATA CAAAATCAGNNNNCTAGCGTTAC | 2031 |
| TGCAGGACCAGAGAATTCGAATA CAAACGGTTCNNNCTAGCGTTAC | 1552 | TGCAGGACCAGAGAATTCGAATA CATAGTCGGTNNNCTAGCGTTAC | 1792 | TGCAGGACCAGAGAATTCGAATA CAAGGCTATCNNNCTAGCGTTAC | 2032 |
| TGCAGGACCAGAGAATTCGAATA CACCCCAATTNNNCTAGCGTTAC | 1553 | TGCAGGACCAGAGAATTCGAATA CATGCGCATANNNCTAGCGTTAC | 1793 | TGCAGGACCAGAGAATTCGAATA CATCTTGTGCNNNCTAGCGTTAC | 2033 |
| TGCAGGACCAGAGAATTCGAATA CAACCGTTCTNNNCTAGCGTTAC | 1554 | TGCAGGACCAGAGAATTCGAATA CATAGAACCNNNNCTAGCGTTAC | 1794 | TGCAGGACCAGAGAATTCGAATA CACCATTCANNNNCTAGCGTTAC | 2034 |
| TGCAGGACCAGAGAATTCGAATA CAACTCTAAANNNCTAGCGTTAC | 1555 | TGCAGGACCAGAGAATTCGAATA CAGGTTTGTNNNNCTAGCGTTAC | 1795 | TGCAGGACCAGAGAATTCGAATA CATAGATTACNNNCTAGCGTTAC | 2035 |
| TGCAGGACCAGAGAATTCGAATA CAATGAGCTCNNNCTAGCGTTAC | 1556 | TGCAGGACCAGAGAATTCGAATA CAAAGTTTGTNNNCTAGCGTTAC | 1796 | TGCAGGACCAGAGAATTCGAATA CAGTTTGCTCNNNCTAGCGTTAC | 2036 |
| TGCAGGACCAGAGAATTCGAATA CATCTAAGGCNNNCTAGCGTTAC | 1557 | TGCAGGACCAGAGAATTCGAATA CATTAGCGACNNNCTAGCGTTAC | 1797 | TGCAGGACCAGAGAATTCGAATA CATCTTCGGTNNNCTAGCGTTAC | 2037 |
| TGCAGGACCAGAGAATTCGAATA CACAATAGCCNNNCTAGCGTTAC | 1558 | TGCAGGACCAGAGAATTCGAATA CAGATATATCNNNCTAGCGTTAC | 1798 | TGCAGGACCAGAGAATTCGAATA CAAGTAGTCCNNNCTAGCGTTAC | 2038 |
| TGCAGGACCAGAGAATTCGAATA CATCTTGCGTNNNCTAGCGTTAC | 1559 | TGCAGGACCAGAGAATTCGAATA CAAACTGTGCNNNCTAGCGTTAC | 1799 | TGCAGGACCAGAGAATTCGAATA CACGGTGTATNNNCTAGCGTTAC | 2039 |
| TGCAGGACCAGAGAATTCGAATA CACAAGAGCANNNCTAGCGTTAC | 1560 | TGCAGGACCAGAGAATTCGAATA CACGAATGGANNNCTAGCGTTAC | 1800 | TGCAGGACCAGAGAATTCGAATA CACTGTTTGCNNNCTAGCGTTAC | 2040 |
| TGCAGGACCAGAGAATTCGAATA CAGCTTGGATNNNCTAGCGTTAC | 1561 | TGCAGGACCAGAGAATTCGAATA CACTTCGTTGNNNCTAGCGTTAC | 1801 | TGCAGGACCAGAGAATTCGAATA CAAACGTGCNNNNCTAGCGTTAC | 2041 |
| TGCAGGACCAGAGAATTCGAATA CACTAAATACNNNCTAGCGTTAC | 1562 | TGCAGGACCAGAGAATTCGAATA CATCGTGGTANNNCTAGCGTTAC | 1802 | TGCAGGACCAGAGAATTCGAATA CAATAAATGNNNNCTAGCGTTAC | 2042 |
| TGCAGGACCAGAGAATTCGAATA CACCTAAAATNNNCTAGCGTTAC | 1563 | TGCAGGACCAGAGAATTCGAATA CAGCAAAATANNNCTAGCGTTAC | 1803 | TGCAGGACCAGAGAATTCGAATA CAACGCGTGCNNNCTAGCGTTAC | 2043 |

FIG. 14E

| Pool-7 | SEQ ID NO: | Pool-8 | SEQ ID NO: | Pool-9 | SEQ ID NO: |
|---|---|---|---|---|---|
| TGCAGGACCAGAGAATTCGAATA CAGAACCTCANNNCTAGCGTTAC | 1564 | TGCAGGACCAGAGAATTCGAATA CAAGACTAAANNNCTAGCGTTAC | 1804 | TGCAGGACCAGAGAATTCGAATA CACGTTGGTANNNCTAGCGTTAC | 2044 |
| TGCAGGACCAGAGAATTCGAATA CAGAGGCCTCNNNCTAGCGTTAC | 1565 | TGCAGGACCAGAGAATTCGAATA CATGGGAGTTNNNCTAGCGTTAC | 1805 | TGCAGGACCAGAGAATTCGAATA CAAGGCGTAANNNCTAGCGTTAC | 2045 |
| TGCAGGACCAGAGAATTCGAATA CAAGGTGATGNNNCTAGCGTTAC | 1566 | TGCAGGACCAGAGAATTCGAATA CAGTTCTGAGNNNCTAGCGTTAC | 1806 | TGCAGGACCAGAGAATTCGAATA CATGCCTATCNNNCTAGCGTTAC | 2046 |
| TGCAGGACCAGAGAATTCGAATA CAACGCGTTANNNCTAGCGTTAC | 1567 | TGCAGGACCAGAGAATTCGAATA CATCGGCGTGNNNCTAGCGTTAC | 1807 | TGCAGGACCAGAGAATTCGAATA CAAAAGCTCCNNNCTAGCGTTAC | 2047 |
| TGCAGGACCAGAGAATTCGAATA CAGGTGGCTCNNNCTAGCGTTAC | 1568 | TGCAGGACCAGAGAATTCGAATA CAGATCCGGCNNNCTAGCGTTAC | 1808 | TGCAGGACCAGAGAATTCGAATA CAAGGACGATNNNCTAGCGTTAC | 2048 |
| TGCAGGACCAGAGAATTCGAATA CAGAGATCAGNNNGATCGACATG | 1569 | TGCAGGACCAGAGAATTCGAATA CAGTGTATGCNNNGATCGACATG | 1809 | TGCAGGACCAGAGAATTCGAATA CACTTGAAGCNNNGATCGACATG | 2049 |
| TGCAGGACCAGAGAATTCGAATA CATACGTGTGNNNGATCGACATG | 1570 | TGCAGGACCAGAGAATTCGAATA CAAGTATTTGNNNGATCGACATG | 1810 | TGCAGGACCAGAGAATTCGAATA CATGCCCTCGNNNGATCGACATG | 2050 |
| TGCAGGACCAGAGAATTCGAATA CAAGTTATCANNNGATCGACATG | 1571 | TGCAGGACCAGAGAATTCGAATA CAAGTAAAACNNNGATCGACATG | 1811 | TGCAGGACCAGAGAATTCGAATA CAAGCGAAACNNNGATCGACATG | 2051 |
| TGCAGGACCAGAGAATTCGAATA CACAGTGATCNNNGATCGACATG | 1572 | TGCAGGACCAGAGAATTCGAATA CAAGCCACCGNNNGATCGACATG | 1812 | TGCAGGACCAGAGAATTCGAATA CATAGAGTGGNNNGATCGACATG | 2052 |
| TGCAGGACCAGAGAATTCGAATA CATACGCGGCNNNGATCGACATG | 1573 | TGCAGGACCAGAGAATTCGAATA CAAAGTGTCCNNNGATCGACATG | 1813 | TGCAGGACCAGAGAATTCGAATA CAAGCAGCAANNNGATCGACATG | 2053 |
| TGCAGGACCAGAGAATTCGAATA CAGTGTGTANNNGATCGACATG | 1574 | TGCAGGACCAGAGAATTCGAATA CACTATTTGTNNNGATCGACATG | 1814 | TGCAGGACCAGAGAATTCGAATA CACCTATTATNNNGATCGACATG | 2054 |
| TGCAGGACCAGAGAATTCGAATA CAGTGTTTAANNNGATCGACATG | 1575 | TGCAGGACCAGAGAATTCGAATA CAGTGTATCGNNNGATCGACATG | 1815 | TGCAGGACCAGAGAATTCGAATA CAGCGACGAGNNNGATCGACATG | 2055 |
| TGCAGGACCAGAGAATTCGAATA CAGCTCTACTNNNGATCGACATG | 1576 | TGCAGGACCAGAGAATTCGAATA CAATAGTATCNNNGATCGACATG | 1816 | TGCAGGACCAGAGAATTCGAATA CAACGATTTANNNGATCGACATG | 2056 |
| TGCAGGACCAGAGAATTCGAATA CATTGTGCTCNNNGATCGACATG | 1577 | TGCAGGACCAGAGAATTCGAATA CACCGCTGAGNNNGATCGACATG | 1817 | TGCAGGACCAGAGAATTCGAATA CAAATTGTTGNNNGATCGACATG | 2057 |
| TGCAGGACCAGAGAATTCGAATA CATATAAGCTNNNGATCGACATG | 1578 | TGCAGGACCAGAGAATTCGAATA CATTATTTANNNGATCGACATG | 1818 | TGCAGGACCAGAGAATTCGAATA CACATTAAGTNNNGATCGACATG | 2058 |
| TGCAGGACCAGAGAATTCGAATA CAAGAACGACNNNGATCGACATG | 1579 | TGCAGGACCAGAGAATTCGAATA CAACAAGACGNNNGATCGACATG | 1819 | TGCAGGACCAGAGAATTCGAATA CAGACGGAGCNNNGATCGACATG | 2059 |
| TGCAGGACCAGAGAATTCGAATA CATACGATATNNNGATCGACATG | 1580 | TGCAGGACCAGAGAATTCGAATA CATAAGTATCNNNGATCGACATG | 1820 | TGCAGGACCAGAGAATTCGAATA CACCGATAGTNNNGATCGACATG | 2060 |
| TGCAGGACCAGAGAATTCGAATA CATAAACCTANNNGATCGACATG | 1581 | TGCAGGACCAGAGAATTCGAATA CAGGCACACCNNNGATCGACATG | 1821 | TGCAGGACCAGAGAATTCGAATA CAAGTATTGTNNNGATCGACATG | 2061 |
| TGCAGGACCAGAGAATTCGAATA CATAACGTTANNNGATCGACATG | 1582 | TGCAGGACCAGAGAATTCGAATA CAGTACCTCANNNGATCGACATG | 1822 | TGCAGGACCAGAGAATTCGAATA CATTTCGGCTNNNGATCGACATG | 2062 |
| TGCAGGACCAGAGAATTCGAATA CAGCACGTGCNNNGATCGACATG | 1583 | TGCAGGACCAGAGAATTCGAATA CACTGTGATGNNNGATCGACATG | 1823 | TGCAGGACCAGAGAATTCGAATA CAGTAGACAGNNNGATCGACATG | 2063 |
| TGCAGGACCAGAGAATTCGAATA CACCCTCGACNNNGATCGACATG | 1584 | TGCAGGACCAGAGAATTCGAATA CAACAAGGACNNNGATCGACATG | 1824 | TGCAGGACCAGAGAATTCGAATA CAACGAAGTGNNNGATCGACATG | 2064 |
| TGCAGGACCAGAGAATTCGAATA CATTGCATCCNNNGATCGACATG | 1585 | TGCAGGACCAGAGAATTCGAATA CAAGAGGCTANNNGATCGACATG | 1825 | TGCAGGACCAGAGAATTCGAATA CACGTCTTTGNNNGATCGACATG | 2065 |
| TGCAGGACCAGAGAATTCGAATA CATCAACTGGNNNGATCGACATG | 1586 | TGCAGGACCAGAGAATTCGAATA CAATTGAGTTNNNGATCGACATG | 1826 | TGCAGGACCAGAGAATTCGAATA CAACACAGGANNNGATCGACATG | 2066 |
| TGCAGGACCAGAGAATTCGAATA CAATTGCCCTNNNGATCGACATG | 1587 | TGCAGGACCAGAGAATTCGAATA CACGTTCTCANNNGATCGACATG | 1827 | TGCAGGACCAGAGAATTCGAATA CAGGTCACTANNNGATCGACATG | 2067 |
| TGCAGGACCAGAGAATTCGAATA CATACATGTANNNGATCGACATG | 1588 | TGCAGGACCAGAGAATTCGAATA CAGGTAGCTTNNNGATCGACATG | 1828 | TGCAGGACCAGAGAATTCGAATA CAGAACGAACNNNGATCGACATG | 2068 |
| TGCAGGACCAGAGAATTCGAATA CAGACTTGGTNNNGATCGACATG | 1589 | TGCAGGACCAGAGAATTCGAATA CATCCTTGTGNNNGATCGACATG | 1829 | TGCAGGACCAGAGAATTCGAATA CACCTAACTCNNNGATCGACATG | 2069 |
| TGCAGGACCAGAGAATTCGAATA CAGTCCCATTNNNGATCGACATG | 1590 | TGCAGGACCAGAGAATTCGAATA CAGCCGACACNNNGATCGACATG | 1830 | TGCAGGACCAGAGAATTCGAATA CAAAGACTTTNNNGATCGACATG | 2070 |
| TGCAGGACCAGAGAATTCGAATA CAAGATGGTGNNNGATCGACATG | 1591 | TGCAGGACCAGAGAATTCGAATA CAACTAGAGGNNNGATCGACATG | 1831 | TGCAGGACCAGAGAATTCGAATA CAGGACATCTNNNGATCGACATG | 2071 |
| TGCAGGACCAGAGAATTCGAATA CAGACACAGANNNGATCGACATG | 1592 | TGCAGGACCAGAGAATTCGAATA CAACAGTCGTNNNGATCGACATG | 1832 | TGCAGGACCAGAGAATTCGAATA CAGGCGTAAANNNGATCGACATG | 2072 |

FIG. 14F

| Pool-7 | SEQ ID NO: | Pool-8 | SEQ ID NO: | Pool-9 | SEQ ID NO: |
|---|---|---|---|---|---|
| TGCAGGACCAGAGAATTCGAATACACGCGTTTTNNNGATCGACATG | 1593 | TGCAGGACCAGAGAATTCGAATACACGAGGCGANNNGATCGACATG | 1833 | TGCAGGACCAGAGAATTCGAATACAGTACCAGTNNNGATCGACATG | 2073 |
| TGCAGGACCAGAGAATTCGAATACACCCAGAGCNNNGATCGACATG | 1594 | TGCAGGACCAGAGAATTCGAATACAACCGAAAGNNNGATCGACATG | 1834 | TGCAGGACCAGAGAATTCGAATACAGAATTACNNNGATCGACATG | 2074 |
| TGCAGGACCAGAGAATTCGAATACACGCAGCTGNNNGATCGACATG | 1595 | TGCAGGACCAGAGAATTCGAATACAGTTTGAGCNNNGATCGACATG | 1835 | TGCAGGACCAGAGAATTCGAATACAAACACCCANNNGATCGACATG | 2075 |
| TGCAGGACCAGAGAATTCGAATACACTTTGGCTNNNGATCGACATG | 1596 | TGCAGGACCAGAGAATTCGAATACAGTATGCGTNNNGATCGACATG | 1836 | TGCAGGACCAGAGAATTCGAATACAAGTTATTGNNNGATCGACATG | 2076 |
| TGCAGGACCAGAGAATTCGAATACAGTTGATCGNNNGATCGACATG | 1597 | TGCAGGACCAGAGAATTCGAATACAATGTAACTNNNGATCGACATG | 1837 | TGCAGGACCAGAGAATTCGAATACACTTCTTTTNNNGATCGACATG | 2077 |
| TGCAGGACCAGAGAATTCGAATACAGTGAAGTGNNNGATCGACATG | 1598 | TGCAGGACCAGAGAATTCGAATACAAGACGTAGNNNGATCGACATG | 1838 | TGCAGGACCAGAGAATTCGAATACAGAGCTCCGNNNGATCGACATG | 2078 |
| TGCAGGACCAGAGAATTCGAATACACACGTTGANNNGATCGACATG | 1599 | TGCAGGACCAGAGAATTCGAATACATTGGCGCGNNNGATCGACATG | 1839 | TGCAGGACCAGAGAATTCGAATACAGAACCCCGNNNGATCGACATG | 2079 |
| TGCAGGACCAGAGAATTCGAATACACAATCCAGNNNGATCGACATG | 1600 | TGCAGGACCAGAGAATTCGAATACAGGACTCATNNNGATCGACATG | 1840 | TGCAGGACCAGAGAATTCGAATACAATTGTGATNNNGATCGACATG | 2080 |
| TGCAGGACCAGAGAATTCGAATACAGCGCAGAGNNNGATCGACATG | 1601 | TGCAGGACCAGAGAATTCGAATACAGTCCGGTGNNNGATCGACATG | 1841 | TGCAGGACCAGAGAATTCGAATACAAGTTCTTTNNNGATCGACATG | 2081 |
| TGCAGGACCAGAGAATTCGAATACACTCTGATCNNNGATCGACATG | 1602 | TGCAGGACCAGAGAATTCGAATACAGCAAGCCCNNNGATCGACATG | 1842 | TGCAGGACCAGAGAATTCGAATACAGCACGGTCNNNGATCGACATG | 2082 |
| TGCAGGACCAGAGAATTCGAATACATATGCCAGNNNGATCGACATG | 1603 | TGCAGGACCAGAGAATTCGAATACAAGCATGGANNNGATCGACATG | 1843 | TGCAGGACCAGAGAATTCGAATACAGTATCCCTNNNGATCGACATG | 2083 |
| TGCAGGACCAGAGAATTCGAATACAGTTGGTCANNNGATCGACATG | 1604 | TGCAGGACCAGAGAATTCGAATACAAGCAGCCCNNNGATCGACATG | 1844 | TGCAGGACCAGAGAATTCGAATACAGCAAGTGANNNGATCGACATG | 2084 |
| TGCAGGACCAGAGAATTCGAATACACCTCTCGGNNNGATCGACATG | 1605 | TGCAGGACCAGAGAATTCGAATACAATCTCTATNNNGATCGACATG | 1845 | TGCAGGACCAGAGAATTCGAATACATAAGATAGNNNGATCGACATG | 2085 |
| TGCAGGACCAGAGAATTCGAATACATGGTACACNNNGATCGACATG | 1606 | TGCAGGACCAGAGAATTCGAATACATAATGCCGNNNGATCGACATG | 1846 | TGCAGGACCAGAGAATTCGAATACAGCAATCTGNNNGATCGACATG | 2086 |
| TGCAGGACCAGAGAATTCGAATACACCTCGGCTNNNGATCGACATG | 1607 | TGCAGGACCAGAGAATTCGAATACACAGGCGGANNNGATCGACATG | 1847 | TGCAGGACCAGAGAATTCGAATACACTGCCAGGNNNGATCGACATG | 2087 |
| TGCAGGACCAGAGAATTCGAATACAGCGACGGANNNGATCGACATG | 1608 | TGCAGGACCAGAGAATTCGAATACAGCGAATGANNNGATCGACATG | 1848 | TGCAGGACCAGAGAATTCGAATACAGGTTTATANNNGATCGACATG | 2088 |
| TGCAGGACCAGAGAATTCGAATACACCCTGATTNNNGATCGACATG | 1609 | TGCAGGACCAGAGAATTCGAATACAAGCGTACTNNNGATCGACATG | 1849 | TGCAGGACCAGAGAATTCGAATACAAACTTGCGNNNGATCGACATG | 2089 |
| TGCAGGACCAGAGAATTCGAATACAATTCTCTANNNGATCGACATG | 1610 | TGCAGGACCAGAGAATTCGAATACACCCAGGCANNNGATCGACATG | 1850 | TGCAGGACCAGAGAATTCGAATACACCAACGCGNNNGATCGACATG | 2090 |
| TGCAGGACCAGAGAATTCGAATACACTGTCAAGGNNNGATCGACATG | 1611 | TGCAGGACCAGAGAATTCGAATACAGGGCCTGTGNNNGATCGACATG | 1851 | TGCAGGACCAGAGAATTCGAATACATGGAAGACNNNGATCGACATG | 2091 |
| TGCAGGACCAGAGAATTCGAATACAATTACCGGNNNGATCGACATG | 1612 | TGCAGGACCAGAGAATTCGAATACACCTAGGCGNNNGATCGACATG | 1852 | TGCAGGACCAGAGAATTCGAATACAATTGAAGANNNGATCGACATG | 2092 |
| TGCAGGACCAGAGAATTCGAATACATAATATCGNNNGATCGACATG | 1613 | TGCAGGACCAGAGAATTCGAATACACCGTTTTGNNNGATCGACATG | 1853 | TGCAGGACCAGAGAATTCGAATACATTTTCACANNNGATCGACATG | 2093 |
| TGCAGGACCAGAGAATTCGAATACAATAGACTTNNNGATCGACATG | 1614 | TGCAGGACCAGAGAATTCGAATACAGACGCACCNNNGATCGACATG | 1854 | TGCAGGACCAGAGAATTCGAATACAACGAACTCNNNGATCGACATG | 2094 |
| TGCAGGACCAGAGAATTCGAATACACCTGATAGNNNGATCGACATG | 1615 | TGCAGGACCAGAGAATTCGAATACAACTTATGANNNGATCGACATG | 1855 | TGCAGGACCAGAGAATTCGAATACAAGGCCGTCNNNGATCGACATG | 2095 |
| TGCAGGACCAGAGAATTCGAATACAGCCGCACANNNGATCGACATG | 1616 | TGCAGGACCAGAGAATTCGAATACAAGATCACANNNGATCGACATG | 1856 | TGCAGGACCAGAGAATTCGAATACATTGGAGCTNNNGATCGACATG | 2096 |
| TGCAGGACCAGAGAATTCGAATACACGAATATTNNNGATCGACATG | 1617 | TGCAGGACCAGAGAATTCGAATACATACTTCCGNNNGATCGACATG | 1857 | TGCAGGACCAGAGAATTCGAATACAACAGACAGNNNGATCGACATG | 2097 |
| TGCAGGACCAGAGAATTCGAATACAGTCAATCGNNNGATCGACATG | 1618 | TGCAGGACCAGAGAATTCGAATACACGTTAGACNNNGATCGACATG | 1858 | TGCAGGACCAGAGAATTCGAATACAATCGTCAGNNNGATCGACATG | 2098 |
| TGCAGGACCAGAGAATTCGAATACATCAGCCCCNNNGATCGACATG | 1619 | TGCAGGACCAGAGAATTCGAATACAGGAGTTAGNNNGATCGACATG | 1859 | TGCAGGACCAGAGAATTCGAATACATTATGTCTNNNGATCGACATG | 2099 |
| TGCAGGACCAGAGAATTCGAATACAGGAGTTCTNNNGATCGACATG | 1620 | TGCAGGACCAGAGAATTCGAATACAGACCTCTTNNNGATCGACATG | 1860 | TGCAGGACCAGAGAATTCGAATACAGTCACGATNNNGATCGACATG | 2100 |
| TGCAGGACCAGAGAATTCGAATACAGTGAATCCNNNGATCGACATG | 1621 | TGCAGGACCAGAGAATTCGAATACAGCCCGCAANNNGATCGACATG | 1861 | TGCAGGACCAGAGAATTCGAATACACATTCTGCNNNGATCGACATG | 2101 |

FIG. 14G

| Pool-7 | SEQ ID NO: | Pool-8 | SEQ ID NO: | Pool-9 | SEQ ID NO: |
|---|---|---|---|---|---|
| TGCAGGACCAGAGAATTCGAATA CAACGATTATNNNGATCGACATG | 1622 | TGCAGGACCAGAGAATTCGAATA CAGAACCCATNNNGATCGACATG | 1862 | TGCAGGACCAGAGAATTCGAATA CAGAAAAACTNNNGATCGACATG | 2102 |
| TGCAGGACCAGAGAATTCGAATA CACAATCCGANNNGATCGACATG | 1623 | TGCAGGACCAGAGAATTCGAATA CACCACTGCCNNNGATCGACATG | 1863 | TGCAGGACCAGAGAATTCGAATA CATCGTCGTTNNNGATCGACATG | 2103 |
| TGCAGGACCAGAGAATTCGAATA CAGGCAATGANNNGATCGACATG | 1624 | TGCAGGACCAGAGAATTCGAATA CACTAATTCNNNGATCGACATG | 1864 | TGCAGGACCAGAGAATTCGAATA CAATTGTGGCNNNGATCGACATG | 2104 |
| TGCAGGACCAGAGAATTCGAATA CACTGTCAGANNNGATCGACATG | 1625 | TGCAGGACCAGAGAATTCGAATA CACGGTCCAGNNNGATCGACATG | 1865 | TGCAGGACCAGAGAATTCGAATA CAACTGGACTNNNGATCGACATG | 2105 |
| TGCAGGACCAGAGAATTCGAATA CACAGACCTANNNGATCGACATG | 1626 | TGCAGGACCAGAGAATTCGAATA CATTTCGCACNNNGATCGACATG | 1866 | TGCAGGACCAGAGAATTCGAATA CACGTTGTTCNNNGATCGACATG | 2106 |
| TGCAGGACCAGAGAATTCGAATA CAGATCATCGNNNGATCGACATG | 1627 | TGCAGGACCAGAGAATTCGAATA CAGGATAAGCNNNGATCGACATG | 1867 | TGCAGGACCAGAGAATTCGAATA CACAAGACCTNNNGATCGACATG | 2107 |
| TGCAGGACCAGAGAATTCGAATA CAGAACGAGTNNNGATCGACATG | 1628 | TGCAGGACCAGAGAATTCGAATA CACTCGCAGGNNNGATCGACATG | 1868 | TGCAGGACCAGAGAATTCGAATA CATACCCCGNNNGATCGACATG | 2108 |
| TGCAGGACCAGAGAATTCGAATA CATCCGTGATNNNTGCATCAGGT | 1629 | TGCAGGACCAGAGAATTCGAATA CAACTGAAAANNNTGCATCAGGT | 1869 | TGCAGGACCAGAGAATTCGAATA CACCTACCGCNNNTGCATCAGGT | 2109 |
| TGCAGGACCAGAGAATTCGAATA CAATTGCAATNNNTGCATCAGGT | 1630 | TGCAGGACCAGAGAATTCGAATA CAAGTCTTTTNNNTGCATCAGGT | 1870 | TGCAGGACCAGAGAATTCGAATA CAAGACAGTGNNNTGCATCAGGT | 2110 |
| TGCAGGACCAGAGAATTCGAATA CATTAACGATNNNTGCATCAGGT | 1631 | TGCAGGACCAGAGAATTCGAATA CAGGTGTTACNNNTGCATCAGGT | 1871 | TGCAGGACCAGAGAATTCGAATA CAGTCCTATCNNNTGCATCAGGT | 2111 |
| TGCAGGACCAGAGAATTCGAATA CATGTACGTGNNNTGCATCAGGT | 1632 | TGCAGGACCAGAGAATTCGAATA CATATCCGCTNNNTGCATCAGGT | 1872 | TGCAGGACCAGAGAATTCGAATA CACGCGCTCTNNNTGCATCAGGT | 2112 |
| TGCAGGACCAGAGAATTCGAATA CAGCGTGTGCNNNTGCATCAGGT | 1633 | TGCAGGACCAGAGAATTCGAATA CAGCGTGAGGNNNTGCATCAGGT | 1873 | TGCAGGACCAGAGAATTCGAATA CATTGATTCTNNNTGCATCAGGT | 2113 |
| TGCAGGACCAGAGAATTCGAATA CACCATATAANNNTGCATCAGGT | 1634 | TGCAGGACCAGAGAATTCGAATA CAGCCGTTCCNNNTGCATCAGGT | 1874 | TGCAGGACCAGAGAATTCGAATA CAATAATGTCNNNTGCATCAGGT | 2114 |
| TGCAGGACCAGAGAATTCGAATA CAAAATTGAGNNNTGCATCAGGT | 1635 | TGCAGGACCAGAGAATTCGAATA CATTACCCCANNNTGCATCAGGT | 1875 | TGCAGGACCAGAGAATTCGAATA CAGAGTTAAANNNTGCATCAGGT | 2115 |
| TGCAGGACCAGAGAATTCGAATA CAGTATCACGNNNTGCATCAGGT | 1636 | TGCAGGACCAGAGAATTCGAATA CAGACCCCTCNNNTGCATCAGGT | 1876 | TGCAGGACCAGAGAATTCGAATA CACGACACATNNNTGCATCAGGT | 2116 |
| TGCAGGACCAGAGAATTCGAATA CACCTTAGGANNNTGCATCAGGT | 1637 | TGCAGGACCAGAGAATTCGAATA CATATGGAGGNNNTGCATCAGGT | 1877 | TGCAGGACCAGAGAATTCGAATA CATTGGCCGNNNTGCATCAGGT | 2117 |
| TGCAGGACCAGAGAATTCGAATA CATAAAAAGCNNNTGCATCAGGT | 1638 | TGCAGGACCAGAGAATTCGAATA CAGACGGTCCNNNTGCATCAGGT | 1878 | TGCAGGACCAGAGAATTCGAATA CAGAACTTTANNNTGCATCAGGT | 2118 |
| TGCAGGACCAGAGAATTCGAATA CATGCATCCTNNNTGCATCAGGT | 1639 | TGCAGGACCAGAGAATTCGAATA CACTACGACANNNTGCATCAGGT | 1879 | TGCAGGACCAGAGAATTCGAATA CACCAAAACCNNNTGCATCAGGT | 2119 |
| TGCAGGACCAGAGAATTCGAATA CACAGCCTGGNNNTGCATCAGGT | 1640 | TGCAGGACCAGAGAATTCGAATA CATGACTACGNNNTGCATCAGGT | 1880 | TGCAGGACCAGAGAATTCGAATA CAATACCAGCNNNTGCATCAGGT | 2120 |
| TGCAGGACCAGAGAATTCGAATA CACACACTAGNNNTGCATCAGGT | 1641 | TGCAGGACCAGAGAATTCGAATA CAGGACGTTNNNTGCATCAGGT | 1881 | TGCAGGACCAGAGAATTCGAATA CAAGTAGAATNNNTGCATCAGGT | 2121 |
| TGCAGGACCAGAGAATTCGAATA CACGTATCCTNNNTGCATCAGGT | 1642 | TGCAGGACCAGAGAATTCGAATA CAAAGCCTCANNNTGCATCAGGT | 1882 | TGCAGGACCAGAGAATTCGAATA CAGTACTACGNNNTGCATCAGGT | 2122 |
| TGCAGGACCAGAGAATTCGAATA CATGGCTTAGNNNTGCATCAGGT | 1643 | TGCAGGACCAGAGAATTCGAATA CACTTTAAAGNNNTGCATCAGGT | 1883 | TGCAGGACCAGAGAATTCGAATA CATTCATGAANNNTGCATCAGGT | 2123 |
| TGCAGGACCAGAGAATTCGAATA CACTGTCATCNNNTGCATCAGGT | 1644 | TGCAGGACCAGAGAATTCGAATA CATTTGATTCNNNTGCATCAGGT | 1884 | TGCAGGACCAGAGAATTCGAATA CACCTAAGGTNNNTGCATCAGGT | 2124 |
| TGCAGGACCAGAGAATTCGAATA CATCCAGAACNNNTGCATCAGGT | 1645 | TGCAGGACCAGAGAATTCGAATA CACTGTATTTNNNTGCATCAGGT | 1885 | TGCAGGACCAGAGAATTCGAATA CAACAAAGGCNNNTGCATCAGGT | 2125 |
| TGCAGGACCAGAGAATTCGAATA CACGAGTACTNNNTGCATCAGGT | 1646 | TGCAGGACCAGAGAATTCGAATA CATTAATTGGNNNTGCATCAGGT | 1886 | TGCAGGACCAGAGAATTCGAATA CAGAGGCAGCNNNTGCATCAGGT | 2126 |
| TGCAGGACCAGAGAATTCGAATA CAGATCGAGANNNTGCATCAGGT | 1647 | TGCAGGACCAGAGAATTCGAATA CACAGAGTTCNNNTGCATCAGGT | 1887 | TGCAGGACCAGAGAATTCGAATA CACTACTCGTNNNTGCATCAGGT | 2127 |
| TGCAGGACCAGAGAATTCGAATA CAAGAATAACNNNTGCATCAGGT | 1648 | TGCAGGACCAGAGAATTCGAATA CAGCATCTAGNNNTGCATCAGGT | 1888 | TGCAGGACCAGAGAATTCGAATA CAGGTAGTGANNNTGCATCAGGT | 2128 |
| TGCAGGACCAGAGAATTCGAATA CAGCGCACCANNNTGCATCAGGT | 1649 | TGCAGGACCAGAGAATTCGAATA CATTGTCTATNNNTGCATCAGGT | 1889 | TGCAGGACCAGAGAATTCGAATA CACCACCACCNNNTGCATCAGGT | 2129 |
| TGCAGGACCAGAGAATTCGAATA CACAGCAACTNNNTGCATCAGGT | 1650 | TGCAGGACCAGAGAATTCGAATA CACATCCTGTNNNTGCATCAGGT | 1890 | TGCAGGACCAGAGAATTCGAATA CATGTGTGACNNNTGCATCAGGT | 2130 |

FIG. 14H

| Pool-7 | SEQ ID NO: | Pool-8 | SEQ ID NO: | Pool-9 | SEQ ID NO: |
|---|---|---|---|---|---|
| TGCAGGACCAGAGAATTCGAATA CAGTGCCATANNNTGCATCAGGT | 1651 | TGCAGGACCAGAGAATTCGAATA CACATTCAAANNNTGCATCAGGT | 1891 | TGCAGGACCAGAGAATTCGAATA CACACCCTGCNNNTGCATCAGGT | 2131 |
| TGCAGGACCAGAGAATTCGAATA CAATCTATTNNNTGCATCAGGT | 1652 | TGCAGGACCAGAGAATTCGAATA CAAAAGCCTCNNNTGCATCAGGT | 1892 | TGCAGGACCAGAGAATTCGAATA CATCGCCATTNNNTGCATCAGGT | 2132 |
| TGCAGGACCAGAGAATTCGAATA CAAGTATGTTNNNTGCATCAGGT | 1653 | TGCAGGACCAGAGAATTCGAATA CATGATCAATNNNTGCATCAGGT | 1893 | TGCAGGACCAGAGAATTCGAATA CAACTTCGCTNNNTGCATCAGGT | 2133 |
| TGCAGGACCAGAGAATTCGAATA CAGGTTCTTCNNNTGCATCAGGT | 1654 | TGCAGGACCAGAGAATTCGAATA CAATATGATCNNNTGCATCAGGT | 1894 | TGCAGGACCAGAGAATTCGAATA CATTGCTTTANNNTGCATCAGGT | 2134 |
| TGCAGGACCAGAGAATTCGAATA CATAGTGGCTNNNTGCATCAGGT | 1655 | TGCAGGACCAGAGAATTCGAATA CAGGACCGAGNNNTGCATCAGGT | 1895 | TGCAGGACCAGAGAATTCGAATA CAGCACGAGGNNNTGCATCAGGT | 2135 |
| TGCAGGACCAGAGAATTCGAATA CACCAACTTCNNNTGCATCAGGT | 1656 | TGCAGGACCAGAGAATTCGAATA CACCCCTAATNNNTGCATCAGGT | 1896 | TGCAGGACCAGAGAATTCGAATA CACGAATGTCNNNTGCATCAGGT | 2136 |
| TGCAGGACCAGAGAATTCGAATA CAAGTTCAATNNNTGCATCAGGT | 1657 | TGCAGGACCAGAGAATTCGAATA CACTCAAAGCNNNTGCATCAGGT | 1897 | TGCAGGACCAGAGAATTCGAATA CATGGCTAGTNNNTGCATCAGGT | 2137 |
| TGCAGGACCAGAGAATTCGAATA CATTGTTCGCNNNTGCATCAGGT | 1658 | TGCAGGACCAGAGAATTCGAATA CACTTCGTACNNNTGCATCAGGT | 1898 | TGCAGGACCAGAGAATTCGAATA CAGTGTTATANNNTGCATCAGGT | 2138 |
| TGCAGGACCAGAGAATTCGAATA CAGTCATGCANNNTGCATCAGGT | 1659 | TGCAGGACCAGAGAATTCGAATA CAATTGGCCANNNTGCATCAGGT | 1899 | TGCAGGACCAGAGAATTCGAATA CATTCCTTCCNNNTGCATCAGGT | 2139 |
| TGCAGGACCAGAGAATTCGAATA CACTGTAATANNNTGCATCAGGT | 1660 | TGCAGGACCAGAGAATTCGAATA CACGAAGGTANNNTGCATCAGGT | 1900 | TGCAGGACCAGAGAATTCGAATA CATCAACTAANNNTGCATCAGGT | 2140 |
| TGCAGGACCAGAGAATTCGAATA CATTCGGCCCNNNTGCATCAGGT | 1661 | TGCAGGACCAGAGAATTCGAATA CAGGCCTTGGNNNTGCATCAGGT | 1901 | TGCAGGACCAGAGAATTCGAATA CATTTACAAGNNNTGCATCAGGT | 2141 |
| TGCAGGACCAGAGAATTCGAATA CATCTCTCTCNNNTGCATCAGGT | 1662 | TGCAGGACCAGAGAATTCGAATA CAACAATATCNNNTGCATCAGGT | 1902 | TGCAGGACCAGAGAATTCGAATA CATCCTGCCGNNNTGCATCAGGT | 2142 |
| TGCAGGACCAGAGAATTCGAATA CACTTCGCGCNNNTGCATCAGGT | 1663 | TGCAGGACCAGAGAATTCGAATA CATCACAACGNNNTGCATCAGGT | 1903 | TGCAGGACCAGAGAATTCGAATA CATCGGCTAANNNTGCATCAGGT | 2143 |
| TGCAGGACCAGAGAATTCGAATA CAACAGATTTNNNTGCATCAGGT | 1664 | TGCAGGACCAGAGAATTCGAATA CAACTGTACGNNNTGCATCAGGT | 1904 | TGCAGGACCAGAGAATTCGAATA CAAGGAGCATNNNTGCATCAGGT | 2144 |
| TGCAGGACCAGAGAATTCGAATA CACAGACAAGNNNTGCATCAGGT | 1665 | TGCAGGACCAGAGAATTCGAATA CATCTCAATTNNNTGCATCAGGT | 1905 | TGCAGGACCAGAGAATTCGAATA CAGGAATACGNNNTGCATCAGGT | 2145 |
| TGCAGGACCAGAGAATTCGAATA CACAGCTACANNNTGCATCAGGT | 1666 | TGCAGGACCAGAGAATTCGAATA CAAGGCTCTANNNTGCATCAGGT | 1906 | TGCAGGACCAGAGAATTCGAATA CATGAGACGANNNTGCATCAGGT | 2146 |
| TGCAGGACCAGAGAATTCGAATA CAGACCGAGGNNNTGCATCAGGT | 1667 | TGCAGGACCAGAGAATTCGAATA CACCTTACCANNNTGCATCAGGT | 1907 | TGCAGGACCAGAGAATTCGAATA CACCACCAGGNNNTGCATCAGGT | 2147 |
| TGCAGGACCAGAGAATTCGAATA CACCTATAAANNNTGCATCAGGT | 1668 | TGCAGGACCAGAGAATTCGAATA CAGATTCCTCNNNTGCATCAGGT | 1908 | TGCAGGACCAGAGAATTCGAATA CAAGCTCATGNNNTGCATCAGGT | 2148 |
| TGCAGGACCAGAGAATTCGAATA CACCTAACCTNNNTGCATCAGGT | 1669 | TGCAGGACCAGAGAATTCGAATA CATGCCTGTTNNNTGCATCAGGT | 1909 | TGCAGGACCAGAGAATTCGAATA CATATACCGGNNNTGCATCAGGT | 2149 |
| TGCAGGACCAGAGAATTCGAATA CATTTAGCGGNNNTGCATCAGGT | 1670 | TGCAGGACCAGAGAATTCGAATA CATCACCAAGNNNTGCATCAGGT | 1910 | TGCAGGACCAGAGAATTCGAATA CAGATGCCATNNNTGCATCAGGT | 2150 |
| TGCAGGACCAGAGAATTCGAATA CATAAACCATNNNTGCATCAGGT | 1671 | TGCAGGACCAGAGAATTCGAATA CACTTCCGGCNNNTGCATCAGGT | 1911 | TGCAGGACCAGAGAATTCGAATA CATTGAGCTGNNNTGCATCAGGT | 2151 |
| TGCAGGACCAGAGAATTCGAATA CAGCTAACTGNNNTGCATCAGGT | 1672 | TGCAGGACCAGAGAATTCGAATA CAAAACGCAGNNNTGCATCAGGT | 1912 | TGCAGGACCAGAGAATTCGAATA CATAAATGGANNNTGCATCAGGT | 2152 |
| TGCAGGACCAGAGAATTCGAATA CAGTACAGAGNNNTGCATCAGGT | 1673 | TGCAGGACCAGAGAATTCGAATA CACGCATTCNNNTGCATCAGGT | 1913 | TGCAGGACCAGAGAATTCGAATA CAACATGAAANNNTGCATCAGGT | 2153 |
| TGCAGGACCAGAGAATTCGAATA CACCGGACCAGATNNNTGCATCAGGT | 1674 | TGCAGGACCAGAGAATTCGAATA CACCCTATTNNNTGCATCAGGT | 1914 | TGCAGGACCAGAGAATTCGAATA CACTCGGAGCNNNTGCATCAGGT | 2154 |
| TGCAGGACCAGAGAATTCGAATA CACCTCTAGTNNNTGCATCAGGT | 1675 | TGCAGGACCAGAGAATTCGAATA CATCATCATTNNNTGCATCAGGT | 1915 | TGCAGGACCAGAGAATTCGAATA CAGTTTCCTGNNNTGCATCAGGT | 2155 |
| TGCAGGACCAGAGAATTCGAATA CAGCCCCTGTNNNTGCATCAGGT | 1676 | TGCAGGACCAGAGAATTCGAATA CAAATTCAGTNNNTGCATCAGGT | 1916 | TGCAGGACCAGAGAATTCGAATA CACAACATGCNNNTGCATCAGGT | 2156 |
| TGCAGGACCAGAGAATTCGAATA CACGGACTGCNNNTGCATCAGGT | 1677 | TGCAGGACCAGAGAATTCGAATA CAATTCTCGCNNNTGCATCAGGT | 1917 | TGCAGGACCAGAGAATTCGAATA CATGGTGCCCNNNTGCATCAGGT | 2157 |
| TGCAGGACCAGAGAATTCGAATA CACCCTCTGGNNNTGCATCAGGT | 1678 | TGCAGGACCAGAGAATTCGAATA CAATAGAGTANNNTGCATCAGGT | 1918 | TGCAGGACCAGAGAATTCGAATA CATACGGAGANNNTGCATCAGGT | 2158 |
| TGCAGGACCAGAGAATTCGAATA CAACCAAGTCNNNTGCATCAGGT | 1679 | TGCAGGACCAGAGAATTCGAATA CAGAGCGGACNNNTGCATCAGGT | 1919 | TGCAGGACCAGAGAATTCGAATA CAGGCGTGGANNNTGCATCAGGT | 2159 |

FIG. 14I

| Pool-7 | SEQ ID NO: | Pool-8 | SEQ ID NO: | Pool-9 | SEQ ID NO: |
|---|---|---|---|---|---|
| TGCAGGACCAGAGAATTCGAATA CAGCGTGGTCNNNTGCATCAGGT | 1680 | TGCAGGACCAGAGAATTCGAATA CAACTTTTACNNNTGCATCAGGT | 1920 | TGCAGGACCAGAGAATTCGAATA CATCTAACGGNNNTGCATCAGGT | 2160 |
| TGCAGGACCAGAGAATTCGAATA CACCGACGCANNNTGCATCAGGT | 1681 | TGCAGGACCAGAGAATTCGAATA CAAGTCAAAANNNTGCATCAGGT | 1921 | TGCAGGACCAGAGAATTCGAATA CATATAGCATNNNTGCATCAGGT | 2161 |
| TGCAGGACCAGAGAATTCGAATA CATTACCGGANNNTGCATCAGGT | 1682 | TGCAGGACCAGAGAATTCGAATA CATCTAGACGNNNTGCATCAGGT | 1922 | TGCAGGACCAGAGAATTCGAATA CACGCTCCGTNNNTGCATCAGGT | 2162 |
| TGCAGGACCAGAGAATTCGAATA CATCTTTGCGNNNTGCATCAGGT | 1683 | TGCAGGACCAGAGAATTCGAATA CACAAATGTTNNNTGCATCAGGT | 1923 | TGCAGGACCAGAGAATTCGAATA CAATACATGTNNNTGCATCAGGT | 2163 |
| TGCAGGACCAGAGAATTCGAATA CACACAATTANNNTGCATCAGGT | 1684 | TGCAGGACCAGAGAATTCGAATA CATGGCTTTCNNNTGCATCAGGT | 1924 | TGCAGGACCAGAGAATTCGAATA CAGGCTCGCANNNTGCATCAGGT | 2164 |
| TGCAGGACCAGAGAATTCGAATA CACCTACATCNNNTGCATCAGGT | 1685 | TGCAGGACCAGAGAATTCGAATA CAAGGCTGTTNNNTGCATCAGGT | 1925 | TGCAGGACCAGAGAATTCGAATA CAGTTTAGTANNNTGCATCAGGT | 2165 |
| TGCAGGACCAGAGAATTCGAATA CAATTACTGANNNTGCATCAGGT | 1686 | TGCAGGACCAGAGAATTCGAATA CAAACTATTGNNNTGCATCAGGT | 1926 | TGCAGGACCAGAGAATTCGAATA CACTGAAATTNNNTGCATCAGGT | 2166 |
| TGCAGGACCAGAGAATTCGAATA CATTTTTCGANNNTGCATCAGGT | 1687 | TGCAGGACCAGAGAATTCGAATA CAATGTATTGNNNTGCATCAGGT | 1927 | TGCAGGACCAGAGAATTCGAATA CAAACACCTGNNNTGCATCAGGT | 2167 |
| TGCAGGACCAGAGAATTCGAATA CAAGGTGCTTNNNTGCATCAGGT | 1688 | TGCAGGACCAGAGAATTCGAATA CACGTCGGCANNNTGCATCAGGT | 1928 | TGCAGGACCAGAGAATTCGAATA CAGGAAAACCNNNTGCATCAGGT | 2168 |

FIG. 15A

| Pool-10 | SEQ ID NO: | Pool-11 | SEQ ID NO: | Pool-12 | SEQ ID NO: |
|---|---|---|---|---|---|
| TGCAGGACCAGAGAATTCGAATACAGCTTCTCANNNACGTATGCCA | 2169 | TGCAGGACCAGAGAATTCGAATACAATACGTATNNNACGTATGCCA | 2409 | TGCAGGACCAGAGAATTCGAATACATTGAGAAANNNACGTATGCCA | 2649 |
| TGCAGGACCAGAGAATTCGAATACAATGCTACGNNNACGTATGCCA | 2170 | TGCAGGACCAGAGAATTCGAATACAAACTAGCCNNNACGTATGCCA | 2410 | TGCAGGACCAGAGAATTCGAATACAAATATCCANNNACGTATGCCA | 2650 |
| TGCAGGACCAGAGAATTCGAATACATACTCTCGNNNACGTATGCCA | 2171 | TGCAGGACCAGAGAATTCGAATACACGGATTACNNNACGTATGCCA | 2411 | TGCAGGACCAGAGAATTCGAATACAATGGACCTNNNACGTATGCCA | 2651 |
| TGCAGGACCAGAGAATTCGAATACACGGTCGCANNNACGTATGCCA | 2172 | TGCAGGACCAGAGAATTCGAATACAGGACGCCTNNNACGTATGCCA | 2412 | TGCAGGACCAGAGAATTCGAATACAGGCATACTNNNACGTATGCCA | 2652 |
| TGCAGGACCAGAGAATTCGAATACAACGGTTACNNNACGTATGCCA | 2173 | TGCAGGACCAGAGAATTCGAATACACGTTAAATNNNACGTATGCCA | 2413 | TGCAGGACCAGAGAATTCGAATACACTAAAAAGNNNACGTATGCCA | 2653 |
| TGCAGGACCAGAGAATTCGAATACATAGCACACNNNACGTATGCCA | 2174 | TGCAGGACCAGAGAATTCGAATACACGCTAGTTNNNACGTATGCCA | 2414 | TGCAGGACCAGAGAATTCGAATACAATACATACNNNACGTATGCCA | 2654 |
| TGCAGGACCAGAGAATTCGAATACACGTCTCTANNNACGTATGCCA | 2175 | TGCAGGACCAGAGAATTCGAATACATCAGAAGGNNNACGTATGCCA | 2415 | TGCAGGACCAGAGAATTCGAATACATATGGCANNNACGTATGCCA | 2655 |
| TGCAGGACCAGAGAATTCGAATACAGCTCCGCTNNNACGTATGCCA | 2176 | TGCAGGACCAGAGAATTCGAATACAACCAACTGNNNACGTATGCCA | 2416 | TGCAGGACCAGAGAATTCGAATACAATGATGCCNNNACGTATGCCA | 2656 |
| TGCAGGACCAGAGAATTCGAATACAGTGGCACNNNACGTATGCCA | 2177 | TGCAGGACCAGAGAATTCGAATACATCGACAACNNNACGTATGCCA | 2417 | TGCAGGACCAGAGAATTCGAATACAAGGTAGGTNNNACGTATGCCA | 2657 |
| TGCAGGACCAGAGAATTCGAATACAGCACTATGNNNACGTATGCCA | 2178 | TGCAGGACCAGAGAATTCGAATACAGTCGTACANNNACGTATGCCA | 2418 | TGCAGGACCAGAGAATTCGAATACATCCCTAGTNNNACGTATGCCA | 2658 |
| TGCAGGACCAGAGAATTCGAATACAATAACGANNNACGTATGCCA | 2179 | TGCAGGACCAGAGAATTCGAATACAGCCAGAGGNNNACGTATGCCA | 2419 | TGCAGGACCAGAGAATTCGAATACAGTATTTGANNNACGTATGCCA | 2659 |
| TGCAGGACCAGAGAATTCGAATACAGGTATAGGNNNACGTATGCCA | 2180 | TGCAGGACCAGAGAATTCGAATACACATAGTATNNNACGTATGCCA | 2420 | TGCAGGACCAGAGAATTCGAATACAAGTGAATANNNACGTATGCCA | 2660 |
| TGCAGGACCAGAGAATTCGAATACAGAACCCTNNNACGTATGCCA | 2181 | TGCAGGACCAGAGAATTCGAATACATAAATGTCNNNACGTATGCCA | 2421 | TGCAGGACCAGAGAATTCGAATACAAATCGCACNNNACGTATGCCA | 2661 |
| TGCAGGACCAGAGAATTCGAATACAGCCGCGTANNNACGTATGCCA | 2182 | TGCAGGACCAGAGAATTCGAATACAGCGTCGGTNNNACGTATGCCA | 2422 | TGCAGGACCAGAGAATTCGAATACAGTCCCCANNNACGTATGCCA | 2662 |
| TGCAGGACCAGAGAATTCGAATACATTCCCTGANNNACGTATGCCA | 2183 | TGCAGGACCAGAGAATTCGAATACATTTGAACANNNACGTATGCCA | 2423 | TGCAGGACCAGAGAATTCGAATACAGCCCACTCNNNACGTATGCCA | 2663 |
| TGCAGGACCAGAGAATTCGAATACAATGGCATNNNACGTATGCCA | 2184 | TGCAGGACCAGAGAATTCGAATACATAACTATGNNNACGTATGCCA | 2424 | TGCAGGACCAGAGAATTCGAATACAGAGATATANNNACGTATGCCA | 2664 |
| TGCAGGACCAGAGAATTCGAATACAAAGGATCGNNNACGTATGCCA | 2185 | TGCAGGACCAGAGAATTCGAATACATCAGATGCNNNACGTATGCCA | 2425 | TGCAGGACCAGAGAATTCGAATACAGCACTACANNNACGTATGCCA | 2665 |
| TGCAGGACCAGAGAATTCGAATACAGTGCATCANNNACGTATGCCA | 2186 | TGCAGGACCAGAGAATTCGAATACACTCAACAGNNNACGTATGCCA | 2426 | TGCAGGACCAGAGAATTCGAATACAACTTTGCCNNNACGTATGCCA | 2666 |
| TGCAGGACCAGAGAATTCGAATACAGTCGTCTTNNNACGTATGCCA | 2187 | TGCAGGACCAGAGAATTCGAATACAATAAAGTCNNNACGTATGCCA | 2427 | TGCAGGACCAGAGAATTCGAATACACTGAGGCCNNNACGTATGCCA | 2667 |
| TGCAGGACCAGAGAATTCGAATACACTTGAGGTNNNACGTATGCCA | 2188 | TGCAGGACCAGAGAATTCGAATACAAGAGCAGTNNNACGTATGCCA | 2428 | TGCAGGACCAGAGAATTCGAATACAAAGTAGGCNNNACGTATGCCA | 2668 |
| TGCAGGACCAGAGAATTCGAATACATACATCAANNNACGTATGCCA | 2189 | TGCAGGACCAGAGAATTCGAATACATATGTCTTNNNACGTATGCCA | 2429 | TGCAGGACCAGAGAATTCGAATACAGCTTCTACNNNACGTATGCCA | 2669 |
| TGCAGGACCAGAGAATTCGAATACACCGAACCGNNNACGTATGCCA | 2190 | TGCAGGACCAGAGAATTCGAATACAGCAGAGATNNNACGTATGCCA | 2430 | TGCAGGACCAGAGAATTCGAATACATGGAGGATNNNACGTATGCCA | 2670 |
| TGCAGGACCAGAGAATTCGAATACACCCACACNNNACGTATGCCA | 2191 | TGCAGGACCAGAGAATTCGAATACATCTCACCANNNACGTATGCCA | 2431 | TGCAGGACCAGAGAATTCGAATACAGCTAACCANNNACGTATGCCA | 2671 |
| TGCAGGACCAGAGAATTCGAATACAACGTAAAANNNACGTATGCCA | 2192 | TGCAGGACCAGAGAATTCGAATACACCCCTTGGNNNACGTATGCCA | 2432 | TGCAGGACCAGAGAATTCGAATACAACCCTTACNNNACGTATGCCA | 2672 |
| TGCAGGACCAGAGAATTCGAATACAGTAGAGTGNNNACGTATGCCA | 2193 | TGCAGGACCAGAGAATTCGAATACACAGTGGCCNNNACGTATGCCA | 2433 | TGCAGGACCAGAGAATTCGAATACAGTCTTCTGNNNACGTATGCCA | 2673 |
| TGCAGGACCAGAGAATTCGAATACACCACATAGNNNACGTATGCCA | 2194 | TGCAGGACCAGAGAATTCGAATACACTGATGCANNNACGTATGCCA | 2434 | TGCAGGACCAGAGAATTCGAATACACGGAGCCTNNNACGTATGCCA | 2674 |
| TGCAGGACCAGAGAATTCGAATACATCTGTGCTNNNACGTATGCCA | 2195 | TGCAGGACCAGAGAATTCGAATACATGGTACCTNNNACGTATGCCA | 2435 | TGCAGGACCAGAGAATTCGAATACACCTGATGANNNACGTATGCCA | 2675 |
| TGCAGGACCAGAGAATTCGAATACATAGTACATNNNACGTATGCCA | 2196 | TGCAGGACCAGAGAATTCGAATACAGTACGGCCNNNACGTATGCCA | 2436 | TGCAGGACCAGAGAATTCGAATACATCGATACGNNNACGTATGCCA | 2676 |
| TGCAGGACCAGAGAATTCGAATACACCGGACACNNNACGTATGCCA | 2197 | TGCAGGACCAGAGAATTCGAATACACCATGCGGNNNACGTATGCCA | 2437 | TGCAGGACCAGAGAATTCGAATACAAGAATGTNNNACGTATGCCA | 2677 |
| TGCAGGACCAGAGAATTCGAATACAGTAAGCTCNNNACGTATGCCA | 2198 | TGCAGGACCAGAGAATTCGAATACACAAGTAGGNNNACGTATGCCA | 2438 | TGCAGGACCAGAGAATTCGAATACATGCGCTCCNNNACGTATGCCA | 2678 |
| TGCAGGACCAGAGAATTCGAATACAACTTGGTGNNNACGTATGCCA | 2199 | TGCAGGACCAGAGAATTCGAATACACATCAAATNNNACGTATGCCA | 2439 | TGCAGGACCAGAGAATTCGAATACAAAGTCATTNNNACGTATGCCA | 2679 |
| TGCAGGACCAGAGAATTCGAATACACGACCTGGNNNACGTATGCCA | 2200 | TGCAGGACCAGAGAATTCGAATACAGACTCGGTTNNNACGTATGCCA | 2440 | TGCAGGACCAGAGAATTCGAATACATGTAATGTNNNACGTATGCCA | 2680 |

FIG. 15B

| Pool-10 | SEQ ID NO: | Pool-11 | SEQ ID NO: | Pool-12 | SEQ ID NO: |
|---|---|---|---|---|---|
| TGCAGGACCAGAGAATTCGAATACAT GAGGATGNNNACGTATGCCA | 2201 | TGCAGGACCAGAGAATTCGAATACAG CAAATTTNNNACGTATGCCA | 2441 | TGCAGGACCAGAGAATTCGAATACAA TCTACCCNNNACGTATGCCA | 2681 |
| TGCAGGACCAGAGAATTCGAATACAC TCGTGCCNNNACGTATGCCA | 2202 | TGCAGGACCAGAGAATTCGAATACAT TAGTGTANNNACGTATGCCA | 2442 | TGCAGGACCAGAGAATTCGAATACAT GCCACAANNNACGTATGCCA | 2682 |
| TGCAGGACCAGAGAATTCGAATACAT TGCTCGTNNNACGTATGCCA | 2203 | TGCAGGACCAGAGAATTCGAATACAG ATGAAATNNNACGTATGCCA | 2443 | TGCAGGACCAGAGAATTCGAATACAG AGTGTTCNNNACGTATGCCA | 2683 |
| TGCAGGACCAGAGAATTCGAATACAA CACTGACNNNACGTATGCCA | 2204 | TGCAGGACCAGAGAATTCGAATACAT TGCCGAANNNACGTATGCCA | 2444 | TGCAGGACCAGAGAATTCGAATACAA ACAGCCTNNNACGTATGCCA | 2684 |
| TGCAGGACCAGAGAATTCGAATACAG TTGGTACNNNACGTATGCCA | 2205 | TGCAGGACCAGAGAATTCGAATACAT CCTCCTTNNNACGTATGCCA | 2445 | TGCAGGACCAGAGAATTCGAATACAG GACGACGNNNACGTATGCCA | 2685 |
| TGCAGGACCAGAGAATTCGAATACAT TCAGTCCNNNACGTATGCCA | 2206 | TGCAGGACCAGAGAATTCGAATACAC CCCATTANNNACGTATGCCA | 2446 | TGCAGGACCAGAGAATTCGAATACAA TTCCGGANNNACGTATGCCA | 2686 |
| TGCAGGACCAGAGAATTCGAATACAG TAACAAANNNACGTATGCCA | 2207 | TGCAGGACCAGAGAATTCGAATACAG TTTGTTTNNNACGTATGCCA | 2447 | TGCAGGACCAGAGAATTCGAATACAG GTCTCAANNNACGTATGCCA | 2687 |
| TGCAGGACCAGAGAATTCGAATACAC AACTGGTNNNACGTATGCCA | 2208 | TGCAGGACCAGAGAATTCGAATACAT ATCCCGTNNNACGTATGCCA | 2448 | TGCAGGACCAGAGAATTCGAATACAC ACCATGANNNACGTATGCCA | 2688 |
| TGCAGGACCAGAGAATTCGAATACAT GGATACCNNNACGTATGCCA | 2209 | TGCAGGACCAGAGAATTCGAATACAT TCGGTGANNNACGTATGCCA | 2449 | TGCAGGACCAGAGAATTCGAATACAC AAACGGANNNACGTATGCCA | 2689 |
| TGCAGGACCAGAGAATTCGAATACAA TGCACCANNNACGTATGCCA | 2210 | TGCAGGACCAGAGAATTCGAATACAC GTAAGGANNNACGTATGCCA | 2450 | TGCAGGACCAGAGAATTCGAATACAA GAGCGTANNNACGTATGCCA | 2690 |
| TGCAGGACCAGAGAATTCGAATACAA CTCCTTGNNNACGTATGCCA | 2211 | TGCAGGACCAGAGAATTCGAATACAC TTTCTTTNNNACGTATGCCA | 2451 | TGCAGGACCAGAGAATTCGAATACAC CCCTGACNNNACGTATGCCA | 2691 |
| TGCAGGACCAGAGAATTCGAATACAA ATAGTTCNNNACGTATGCCA | 2212 | TGCAGGACCAGAGAATTCGAATACAG ACTTTTTNNNACGTATGCCA | 2452 | TGCAGGACCAGAGAATTCGAATACAC CAAGTTGNNNACGTATGCCA | 2692 |
| TGCAGGACCAGAGAATTCGAATACAT GAGAGCANNNACGTATGCCA | 2213 | TGCAGGACCAGAGAATTCGAATACAG GTTAAGGNNNACGTATGCCA | 2453 | TGCAGGACCAGAGAATTCGAATACAT GTGTAATNNNACGTATGCCA | 2693 |
| TGCAGGACCAGAGAATTCGAATACAT CACCCCGNNNACGTATGCCA | 2214 | TGCAGGACCAGAGAATTCGAATACAA TCACGGTNNNACGTATGCCA | 2454 | TGCAGGACCAGAGAATTCGAATACAA TTTGTGANNNACGTATGCCA | 2694 |
| TGCAGGACCAGAGAATTCGAATACAT AATGGAANNNACGTATGCCA | 2215 | TGCAGGACCAGAGAATTCGAATACAC ATTTAGANNNACGTATGCCA | 2455 | TGCAGGACCAGAGAATTCGAATACAG TAGCGTTNNNACGTATGCCA | 2695 |
| TGCAGGACCAGAGAATTCGAATACAT CCAAATANNNACGTATGCCA | 2216 | TGCAGGACCAGAGAATTCGAATACAC ACGCGCANNNACGTATGCCA | 2456 | TGCAGGACCAGAGAATTCGAATACAC ACGTGATNNNACGTATGCCA | 2696 |
| TGCAGGACCAGAGAATTCGAATACAG AGGCTCCNNNACGTATGCCA | 2217 | TGCAGGACCAGAGAATTCGAATACAG TGAATCGNNNACGTATGCCA | 2457 | TGCAGGACCAGAGAATTCGAATACAA ACAGCGANNNACGTATGCCA | 2697 |
| TGCAGGACCAGAGAATTCGAATACAT CCGCGTCNNNACGTATGCCA | 2218 | TGCAGGACCAGAGAATTCGAATACAT TGTGTAANNNACGTATGCCA | 2458 | TGCAGGACCAGAGAATTCGAATACAA AATGCGGNNNACGTATGCCA | 2698 |
| TGCAGGACCAGAGAATTCGAATACAG CATTGCANNNACGTATGCCA | 2219 | TGCAGGACCAGAGAATTCGAATACAC CGCGTGANNNACGTATGCCA | 2459 | TGCAGGACCAGAGAATTCGAATACAT ACCAAGCNNNACGTATGCCA | 2699 |
| TGCAGGACCAGAGAATTCGAATACAC CCCTTAANNNACGTATGCCA | 2220 | TGCAGGACCAGAGAATTCGAATACAA ACCAAGGNNNACGTATGCCA | 2460 | TGCAGGACCAGAGAATTCGAATACAC GACCCTCNNNACGTATGCCA | 2700 |
| TGCAGGACCAGAGAATTCGAATACAG ACCGCCANNNACGTATGCCA | 2221 | TGCAGGACCAGAGAATTCGAATACAT CGTTTGCNNNACGTATGCCA | 2461 | TGCAGGACCAGAGAATTCGAATACAA CACCCCTNNNACGTATGCCA | 2701 |
| TGCAGGACCAGAGAATTCGAATACAG ATCTGACNNNACGTATGCCA | 2222 | TGCAGGACCAGAGAATTCGAATACAC TATTCGCNNNACGTATGCCA | 2462 | TGCAGGACCAGAGAATTCGAATACAC TGTCGCCNNNACGTATGCCA | 2702 |
| TGCAGGACCAGAGAATTCGAATACAG CATGTTGNNNACGTATGCCA | 2223 | TGCAGGACCAGAGAATTCGAATACAA ACAGATANNNACGTATGCCA | 2463 | TGCAGGACCAGAGAATTCGAATACAA GCCGCCANNNACGTATGCCA | 2703 |
| TGCAGGACCAGAGAATTCGAATACAT AGCACGTNNNACGTATGCCA | 2224 | TGCAGGACCAGAGAATTCGAATACAC TATTATCNNNACGTATGCCA | 2464 | TGCAGGACCAGAGAATTCGAATACAT GTACAATNNNACGTATGCCA | 2704 |
| TGCAGGACCAGAGAATTCGAATACAG GTCCAATNNNACGTATGCCA | 2225 | TGCAGGACCAGAGAATTCGAATACAT CCCAATCNNNACGTATGCCA | 2465 | TGCAGGACCAGAGAATTCGAATACAG ATCTACGNNNACGTATGCCA | 2705 |
| TGCAGGACCAGAGAATTCGAATACAA CCCTCTANNNACGTATGCCA | 2226 | TGCAGGACCAGAGAATTCGAATACAC TAAAGTTNNNACGTATGCCA | 2466 | TGCAGGACCAGAGAATTCGAATACAC CAGTCTTNNNACGTATGCCA | 2706 |
| TGCAGGACCAGAGAATTCGAATACAT TACGACGNNNACGTATGCCA | 2227 | TGCAGGACCAGAGAATTCGAATACAA GCTAATTNNNACGTATGCCA | 2467 | TGCAGGACCAGAGAATTCGAATACAG CTGCAATNNNACGTATGCCA | 2707 |
| TGCAGGACCAGAGAATTCGAATACAC ATATCGGNNNACGTATGCCA | 2228 | TGCAGGACCAGAGAATTCGAATACAT TGTTATCNNNACGTATGCCA | 2468 | TGCAGGACCAGAGAATTCGAATACAG AAGAGTCNNNACGTATGCCA | 2708 |
| TGCAGGACCAGAGAATTCGAATACAG CGATATCNNNCTAGCGTTAC | 2229 | TGCAGGACCAGAGAATTCGAATACAA AGTACGCNNNCTAGCGTTAC | 2469 | TGCAGGACCAGAGAATTCGAATACAA CAACTCGNNNCTAGCGTTAC | 2709 |
| TGCAGGACCAGAGAATTCGAATACAT ACGAGGANNNCTAGCGTTAC | 2230 | TGCAGGACCAGAGAATTCGAATACAC AGGCTATNNNCTAGCGTTAC | 2470 | TGCAGGACCAGAGAATTCGAATACAT GCGCAATNNNCTAGCGTTAC | 2710 |
| TGCAGGACCAGAGAATTCGAATACAT CTTACATNNNCTAGCGTTAC | 2231 | TGCAGGACCAGAGAATTCGAATACAC ATTAGTANNNCTAGCGTTAC | 2471 | TGCAGGACCAGAGAATTCGAATACAT AAGAACANNNCTAGCGTTAC | 2711 |
| TGCAGGACCAGAGAATTCGAATACAG CGTCTCCNNNCTAGCGTTAC | 2232 | TGCAGGACCAGAGAATTCGAATACAC CTCTAACNNNCTAGCGTTAC | 2472 | TGCAGGACCAGAGAATTCGAATACAC GCTTGCCNNNCTAGCGTTAC | 2712 |

FIG. 15C

| Pool-10 | SEQ ID NO: | Pool-11 | SEQ ID NO: | Pool-12 | SEQ ID NO: |
|---|---|---|---|---|---|
| TGCAGGACCAGAGAATTCGAATACATAATCCGGNNNCTAGCGTTAC | 2233 | TGCAGGACCAGAGAATTCGAATACATAGTGTCGNNNCTAGCGTTAC | 2473 | TGCAGGACCAGAGAATTCGAATACATTACACGGNNNCTAGCGTTAC | 2713 |
| TGCAGGACCAGAGAATTCGAATACACAGCATACNNNCTAGCGTTAC | 2234 | TGCAGGACCAGAGAATTCGAATACACGCAGAGGNNNCTAGCGTTAC | 2474 | TGCAGGACCAGAGAATTCGAATACACTCCACCGNNNCTAGCGTTAC | 2714 |
| TGCAGGACCAGAGAATTCGAATACAGTTCTCCANNNCTAGCGTTAC | 2235 | TGCAGGACCAGAGAATTCGAATACAGCGGTTCGNNNCTAGCGTTAC | 2475 | TGCAGGACCAGAGAATTCGAATACACGACCCAGNNNCTAGCGTTAC | 2715 |
| TGCAGGACCAGAGAATTCGAATACAAGTTCCTCNNNCTAGCGTTAC | 2236 | TGCAGGACCAGAGAATTCGAATACACCAGAGTTNNNCTAGCGTTAC | 2476 | TGCAGGACCAGAGAATTCGAATACACGGTCAGNNNCTAGCGTTAC | 2716 |
| TGCAGGACCAGAGAATTCGAATACAAAATCGAANNNCTAGCGTTAC | 2237 | TGCAGGACCAGAGAATTCGAATACATGATGAAANNNCTAGCGTTAC | 2477 | TGCAGGACCAGAGAATTCGAATACACACTATCCNNNCTAGCGTTAC | 2717 |
| TGCAGGACCAGAGAATTCGAATACAAGATTATCNNNCTAGCGTTAC | 2238 | TGCAGGACCAGAGAATTCGAATACACGTGAATGNNNCTAGCGTTAC | 2478 | TGCAGGACCAGAGAATTCGAATACACTAGTCTCNNNCTAGCGTTAC | 2718 |
| TGCAGGACCAGAGAATTCGAATACAGTTTCACCNNNCTAGCGTTAC | 2239 | TGCAGGACCAGAGAATTCGAATACACTATGTGCNNNCTAGCGTTAC | 2479 | TGCAGGACCAGAGAATTCGAATACATACCTTCGNNNCTAGCGTTAC | 2719 |
| TGCAGGACCAGAGAATTCGAATACAATTACATGNNNCTAGCGTTAC | 2240 | TGCAGGACCAGAGAATTCGAATACAAATACTACNNNCTAGCGTTAC | 2480 | TGCAGGACCAGAGAATTCGAATACAAACCAGAGNNNCTAGCGTTAC | 2720 |
| TGCAGGACCAGAGAATTCGAATACAACCATCCTNNNCTAGCGTTAC | 2241 | TGCAGGACCAGAGAATTCGAATACATTCGGATGNNNCTAGCGTTAC | 2481 | TGCAGGACCAGAGAATTCGAATACATGACTCGANNNCTAGCGTTAC | 2721 |
| TGCAGGACCAGAGAATTCGAATACACAGACTACNNNCTAGCGTTAC | 2242 | TGCAGGACCAGAGAATTCGAATACATACATTAGNNNCTAGCGTTAC | 2482 | TGCAGGACCAGAGAATTCGAATACAACCCAGATNNNCTAGCGTTAC | 2722 |
| TGCAGGACCAGAGAATTCGAATACACATTGGTGNNNCTAGCGTTAC | 2243 | TGCAGGACCAGAGAATTCGAATACATGGCCCGANNNCTAGCGTTAC | 2483 | TGCAGGACCAGAGAATTCGAATACATGCGCTTTNNNCTAGCGTTAC | 2723 |
| TGCAGGACCAGAGAATTCGAATACAGAGACCTTNNNCTAGCGTTAC | 2244 | TGCAGGACCAGAGAATTCGAATACAGTTGAGTCNNNCTAGCGTTAC | 2484 | TGCAGGACCAGAGAATTCGAATACAGGAGGACCNNNCTAGCGTTAC | 2724 |
| TGCAGGACCAGAGAATTCGAATACATCAGGCCGNNNCTAGCGTTAC | 2245 | TGCAGGACCAGAGAATTCGAATACAGTTAGCACNNNCTAGCGTTAC | 2485 | TGCAGGACCAGAGAATTCGAATACATCGTCCATNNNCTAGCGTTAC | 2725 |
| TGCAGGACCAGAGAATTCGAATACACAACACACNNNCTAGCGTTAC | 2246 | TGCAGGACCAGAGAATTCGAATACAAGTTCCCTNNNCTAGCGTTAC | 2486 | TGCAGGACCAGAGAATTCGAATACACGACCTCCNNNCTAGCGTTAC | 2726 |
| TGCAGGACCAGAGAATTCGAATACACGACGTCGNNNCTAGCGTTAC | 2247 | TGCAGGACCAGAGAATTCGAATACACATGGAGANNNCTAGCGTTAC | 2487 | TGCAGGACCAGAGAATTCGAATACAAGATTCCGNNNCTAGCGTTAC | 2727 |
| TGCAGGACCAGAGAATTCGAATACATAGACTATNNNCTAGCGTTAC | 2248 | TGCAGGACCAGAGAATTCGAATACAAATCGTCGNNNCTAGCGTTAC | 2488 | TGCAGGACCAGAGAATTCGAATACAACTCGAACNNNCTAGCGTTAC | 2728 |
| TGCAGGACCAGAGAATTCGAATACACCGAGAAANNNCTAGCGTTAC | 2249 | TGCAGGACCAGAGAATTCGAATACAACTCGCAANNNCTAGCGTTAC | 2489 | TGCAGGACCAGAGAATTCGAATACAAGACGATGNNNCTAGCGTTAC | 2729 |
| TGCAGGACCAGAGAATTCGAATACATTCCATATNNNCTAGCGTTAC | 2250 | TGCAGGACCAGAGAATTCGAATACATCAGCCTTNNNCTAGCGTTAC | 2490 | TGCAGGACCAGAGAATTCGAATACAGAACTTATNNNCTAGCGTTAC | 2730 |
| TGCAGGACCAGAGAATTCGAATACAGCCATGATNNNCTAGCGTTAC | 2251 | TGCAGGACCAGAGAATTCGAATACATTGCCTCANNNCTAGCGTTAC | 2491 | TGCAGGACCAGAGAATTCGAATACAACCAGCGCNNNCTAGCGTTAC | 2731 |
| TGCAGGACCAGAGAATTCGAATACAGGCGACGANNNCTAGCGTTAC | 2252 | TGCAGGACCAGAGAATTCGAATACAGGACCCACNNNCTAGCGTTAC | 2492 | TGCAGGACCAGAGAATTCGAATACATACCTCTGNNNCTAGCGTTAC | 2732 |
| TGCAGGACCAGAGAATTCGAATACACCCAGTAANNNCTAGCGTTAC | 2253 | TGCAGGACCAGAGAATTCGAATACATTCTCCAGNNNCTAGCGTTAC | 2493 | TGCAGGACCAGAGAATTCGAATACACGGAGCGANNNCTAGCGTTAC | 2733 |
| TGCAGGACCAGAGAATTCGAATACACTCAAACGNNNCTAGCGTTAC | 2254 | TGCAGGACCAGAGAATTCGAATACAGTCCTCGCNNNCTAGCGTTAC | 2494 | TGCAGGACCAGAGAATTCGAATACAACCCGAAANNNCTAGCGTTAC | 2734 |
| TGCAGGACCAGAGAATTCGAATACACAGATCTGNNNCTAGCGTTAC | 2255 | TGCAGGACCAGAGAATTCGAATACAAATAGTCTNNNCTAGCGTTAC | 2495 | TGCAGGACCAGAGAATTCGAATACAGGATCGCCNNNCTAGCGTTAC | 2735 |
| TGCAGGACCAGAGAATTCGAATACAAGAAAATCNNNCTAGCGTTAC | 2256 | TGCAGGACCAGAGAATTCGAATACAGCTGGATTNNNCTAGCGTTAC | 2496 | TGCAGGACCAGAGAATTCGAATACAATCAGCACNNNCTAGCGTTAC | 2736 |
| TGCAGGACCAGAGAATTCGAATACAATCTTTCANNNCTAGCGTTAC | 2257 | TGCAGGACCAGAGAATTCGAATACATTCGTCACNNNCTAGCGTTAC | 2497 | TGCAGGACCAGAGAATTCGAATACAAACTCTCCNNNCTAGCGTTAC | 2737 |
| TGCAGGACCAGAGAATTCGAATACACCCATCTANNNCTAGCGTTAC | 2258 | TGCAGGACCAGAGAATTCGAATACAATTATGACNNNCTAGCGTTAC | 2498 | TGCAGGACCAGAGAATTCGAATACATATGAGTTNNNCTAGCGTTAC | 2738 |
| TGCAGGACCAGAGAATTCGAATACACTAAGGTCNNNCTAGCGTTAC | 2259 | TGCAGGACCAGAGAATTCGAATACATTTTAGAGNNNCTAGCGTTAC | 2499 | TGCAGGACCAGAGAATTCGAATACAAGGCGTCCNNNCTAGCGTTAC | 2739 |
| TGCAGGACCAGAGAATTCGAATACACACCGACGNNNCTAGCGTTAC | 2260 | TGCAGGACCAGAGAATTCGAATACAGATATACTNNNCTAGCGTTAC | 2500 | TGCAGGACCAGAGAATTCGAATACAAGAATTAGNNNCTAGCGTTAC | 2740 |
| TGCAGGACCAGAGAATTCGAATACAGTTTAGATNNNCTAGCGTTAC | 2261 | TGCAGGACCAGAGAATTCGAATACAGCTACCCGNNNCTAGCGTTAC | 2501 | TGCAGGACCAGAGAATTCGAATACAAATTTAGTNNNCTAGCGTTAC | 2741 |
| TGCAGGACCAGAGAATTCGAATACATCCCCTCCNNNCTAGCGTTAC | 2262 | TGCAGGACCAGAGAATTCGAATACAAACCTTTTNNNCTAGCGTTAC | 2502 | TGCAGGACCAGAGAATTCGAATACATATTTCTGNNNCTAGCGTTAC | 2742 |
| TGCAGGACCAGAGAATTCGAATACATTAATCAGNNNCTAGCGTTAC | 2263 | TGCAGGACCAGAGAATTCGAATACAATGTGTATNNNCTAGCGTTAC | 2503 | TGCAGGACCAGAGAATTCGAATACAGCTGTACANNNCTAGCGTTAC | 2743 |
| TGCAGGACCAGAGAATTCGAATACACATTCGAGNNNCTAGCGTTAC | 2264 | TGCAGGACCAGAGAATTCGAATACATCCCACGCNNNCTAGCGTTAC | 2504 | TGCAGGACCAGAGAATTCGAATACAGCTTACGANNNCTAGCGTTAC | 2744 |

FIG. 15D

| Pool-10 | SEQ ID NO: | Pool-11 | SEQ ID NO: | Pool-12 | SEQ ID NO: |
|---|---|---|---|---|---|
| TGCAGGACCAGAGAATTCGAATACAAACCGTGTNNNCTAGCGTTAC | 2265 | TGCAGGACCAGAGAATTCGAATACACGCCTCTGNNNCTAGCGTTAC | 2505 | TGCAGGACCAGAGAATTCGAATACACCCACGGANNNCTAGCGTTAC | 2745 |
| TGCAGGACCAGAGAATTCGAATACACCCAATTCNNNCTAGCGTTAC | 2266 | TGCAGGACCAGAGAATTCGAATACACTATAACANNNCTAGCGTTAC | 2506 | TGCAGGACCAGAGAATTCGAATACATGGATCTGNNNCTAGCGTTAC | 2746 |
| TGCAGGACCAGAGAATTCGAATACATTGGTGGTNNNCTAGCGTTAC | 2267 | TGCAGGACCAGAGAATTCGAATACAGACTGACTNNNCTAGCGTTAC | 2507 | TGCAGGACCAGAGAATTCGAATACATCCACGAANNNCTAGCGTTAC | 2747 |
| TGCAGGACCAGAGAATTCGAATACATGCTTAGGNNNCTAGCGTTAC | 2268 | TGCAGGACCAGAGAATTCGAATACACTGGCCAGNNNCTAGCGTTAC | 2508 | TGCAGGACCAGAGAATTCGAATACATCAAGACCNNNCTAGCGTTAC | 2748 |
| TGCAGGACCAGAGAATTCGAATACAACACCCCCNNNCTAGCGTTAC | 2269 | TGCAGGACCAGAGAATTCGAATACAAAGCGAGNNNCTAGCGTTAC | 2509 | TGCAGGACCAGAGAATTCGAATACAGGCAGACGNNNCTAGCGTTAC | 2749 |
| TGCAGGACCAGAGAATTCGAATACACCATTGAGNNNCTAGCGTTAC | 2270 | TGCAGGACCAGAGAATTCGAATACACGCTTTTGNNNCTAGCGTTAC | 2510 | TGCAGGACCAGAGAATTCGAATACATTTTTACGNNNCTAGCGTTAC | 2750 |
| TGCAGGACCAGAGAATTCGAATACAACTTAAACNNNCTAGCGTTAC | 2271 | TGCAGGACCAGAGAATTCGAATACATTTCCCTCNNNCTAGCGTTAC | 2511 | TGCAGGACCAGAGAATTCGAATACAGCGTTTGANNNCTAGCGTTAC | 2751 |
| TGCAGGACCAGAGAATTCGAATACATATAGTACNNNCTAGCGTTAC | 2272 | TGCAGGACCAGAGAATTCGAATACACTTACTCGNNNCTAGCGTTAC | 2512 | TGCAGGACCAGAGAATTCGAATACAAGGTACTNNNCTAGCGTTAC | 2752 |
| TGCAGGACCAGAGAATTCGAATACACAGTGTACNNNCTAGCGTTAC | 2273 | TGCAGGACCAGAGAATTCGAATACAATCGAGTCNNNCTAGCGTTAC | 2513 | TGCAGGACCAGAGAATTCGAATACATTCTGTTANNNCTAGCGTTAC | 2753 |
| TGCAGGACCAGAGAATTCGAATACAGCGTCTTTNNNCTAGCGTTAC | 2274 | TGCAGGACCAGAGAATTCGAATACATTGTACGGNNNCTAGCGTTAC | 2514 | TGCAGGACCAGAGAATTCGAATACACCGATGTANNNCTAGCGTTAC | 2754 |
| TGCAGGACCAGAGAATTCGAATACATGACTCAGNNNCTAGCGTTAC | 2275 | TGCAGGACCAGAGAATTCGAATACACACCATTCNNNCTAGCGTTAC | 2515 | TGCAGGACCAGAGAATTCGAATACAGTCGGTTANNNCTAGCGTTAC | 2755 |
| TGCAGGACCAGAGAATTCGAATACAACTTAGTANNNCTAGCGTTAC | 2276 | TGCAGGACCAGAGAATTCGAATACACCCTCTTTNNNCTAGCGTTAC | 2516 | TGCAGGACCAGAGAATTCGAATACACGAACCCGNNNCTAGCGTTAC | 2756 |
| TGCAGGACCAGAGAATTCGAATACAAAACATGANNNCTAGCGTTAC | 2277 | TGCAGGACCAGAGAATTCGAATACATGCATTAANNNCTAGCGTTAC | 2517 | TGCAGGACCAGAGAATTCGAATACATTCGACTCNNNCTAGCGTTAC | 2757 |
| TGCAGGACCAGAGAATTCGAATACAGTTAGGCTNNNCTAGCGTTAC | 2278 | TGCAGGACCAGAGAATTCGAATACACGTAGCGCNNNCTAGCGTTAC | 2518 | TGCAGGACCAGAGAATTCGAATACATTCAGCCTNNNCTAGCGTTAC | 2758 |
| TGCAGGACCAGAGAATTCGAATACATCCGCAGGNNNCTAGCGTTAC | 2279 | TGCAGGACCAGAGAATTCGAATACAGTCTCCTANNNCTAGCGTTAC | 2519 | TGCAGGACCAGAGAATTCGAATACACACTTGAGNNNCTAGCGTTAC | 2759 |
| TGCAGGACCAGAGAATTCGAATACAAGTACATTNNNCTAGCGTTAC | 2280 | TGCAGGACCAGAGAATTCGAATACATGCGCCGANNNCTAGCGTTAC | 2520 | TGCAGGACCAGAGAATTCGAATACATCACGCGGNNNCTAGCGTTAC | 2760 |
| TGCAGGACCAGAGAATTCGAATACAGGTCGTATNNNCTAGCGTTAC | 2281 | TGCAGGACCAGAGAATTCGAATACACAATGATTNNNCTAGCGTTAC | 2521 | TGCAGGACCAGAGAATTCGAATACACACTGTAGNNNCTAGCGTTAC | 2761 |
| TGCAGGACCAGAGAATTCGAATACAAGACGACANNNCTAGCGTTAC | 2282 | TGCAGGACCAGAGAATTCGAATACAAGCGAGGCNNNCTAGCGTTAC | 2522 | TGCAGGACCAGAGAATTCGAATACAACCAAGCTNNNCTAGCGTTAC | 2762 |
| TGCAGGACCAGAGAATTCGAATACAAAGTTCTANNNCTAGCGTTAC | 2283 | TGCAGGACCAGAGAATTCGAATACATTGAATACNNNCTAGCGTTAC | 2523 | TGCAGGACCAGAGAATTCGAATACAACTGCAACNNNCTAGCGTTAC | 2763 |
| TGCAGGACCAGAGAATTCGAATACAACCGAACTNNNCTAGCGTTAC | 2284 | TGCAGGACCAGAGAATTCGAATACAACCGCCAGNNNCTAGCGTTAC | 2524 | TGCAGGACCAGAGAATTCGAATACATAACGGTCNNNCTAGCGTTAC | 2764 |
| TGCAGGACCAGAGAATTCGAATACAGGCAATTCNNNCTAGCGTTAC | 2285 | TGCAGGACCAGAGAATTCGAATACAGGCGACAGNNNCTAGCGTTAC | 2525 | TGCAGGACCAGAGAATTCGAATACAAGTTTGTANNNCTAGCGTTAC | 2765 |
| TGCAGGACCAGAGAATTCGAATACAGTCACACANNNCTAGCGTTAC | 2286 | TGCAGGACCAGAGAATTCGAATACATATCCAANNNCTAGCGTTAC | 2526 | TGCAGGACCAGAGAATTCGAATACACACGTTTCNNNCTAGCGTTAC | 2766 |
| TGCAGGACCAGAGAATTCGAATACACGGAAATGNNNCTAGCGTTAC | 2287 | TGCAGGACCAGAGAATTCGAATACAATGTTGTANNNCTAGCGTTAC | 2527 | TGCAGGACCAGAGAATTCGAATACATTAAAACCNNNCTAGCGTTAC | 2767 |
| TGCAGGACCAGAGAATTCGAATACACTGTCTACNNNCTAGCGTTAC | 2288 | TGCAGGACCAGAGAATTCGAATACAGATTGTTANNNCTAGCGTTAC | 2528 | TGCAGGACCAGAGAATTCGAATACATTCGTAGGNNNCTAGCGTTAC | 2768 |
| TGCAGGACCAGAGAATTCGAATACAGAGCCAGGNNNGATCGACATG | 2289 | TGCAGGACCAGAGAATTCGAATACAGTCCACGGNNNGATCGACATG | 2529 | TGCAGGACCAGAGAATTCGAATACATGCGTAGTNNNGATCGACATG | 2769 |
| TGCAGGACCAGAGAATTCGAATACACACTCCTANNNGATCGACATG | 2290 | TGCAGGACCAGAGAATTCGAATACATGACTGACNNNGATCGACATG | 2530 | TGCAGGACCAGAGAATTCGAATACAGCTTTGNNNGATCGACATG | 2770 |
| TGCAGGACCAGAGAATTCGAATACACTTTCCCTNNNGATCGACATG | 2291 | TGCAGGACCAGAGAATTCGAATACATGATTTAGNNNGATCGACATG | 2531 | TGCAGGACCAGAGAATTCGAATACAGTAAATAGNNNGATCGACATG | 2771 |
| TGCAGGACCAGAGAATTCGAATACACTGAGCTANNNGATCGACATG | 2292 | TGCAGGACCAGAGAATTCGAATACAACATACTANNNGATCGACATG | 2532 | TGCAGGACCAGAGAATTCGAATACACGCTGTCCNNNGATCGACATG | 2772 |
| TGCAGGACCAGAGAATTCGAATACAGTCTGACANNNGATCGACATG | 2293 | TGCAGGACCAGAGAATTCGAATACAAGCATCANNNGATCGACATG | 2533 | TGCAGGACCAGAGAATTCGAATACACTTAGAGCNNNGATCGACATG | 2773 |
| TGCAGGACCAGAGAATTCGAATACACTGACGCGNNNGATCGACATG | 2294 | TGCAGGACCAGAGAATTCGAATACAACGGCAAANNNGATCGACATG | 2534 | TGCAGGACCAGAGAATTCGAATACAGGACATAGNNNGATCGACATG | 2774 |
| TGCAGGACCAGAGAATTCGAATACAGTGATGGANNNGATCGACATG | 2295 | TGCAGGACCAGAGAATTCGAATACACTTTGCTGNNNGATCGACATG | 2535 | TGCAGGACCAGAGAATTCGAATACATCTACAGGNNNGATCGACATG | 2775 |
| TGCAGGACCAGAGAATTCGAATACAGAATTCTANNNGATCGACATG | 2296 | TGCAGGACCAGAGAATTCGAATACATTAACTAGNNNGATCGACATG | 2536 | TGCAGGACCAGAGAATTCGAATACACAAACTCGNNNGATCGACATG | 2776 |

FIG. 15E

| Pool-10 | SEQ ID NO: | Pool-11 | SEQ ID NO: | Pool-12 | SEQ ID NO: |
|---|---|---|---|---|---|
| TGCAGGACCAGAGAATTCGAATACAC GTGCATANNNGATCGACATG | 2297 | TGCAGGACCAGAGAATTCGAATACAC GTACTGANNNGATCGACATG | 2537 | TGCAGGACCAGAGAATTCGAATACAG CTATTCCNNNGATCGACATG | 2777 |
| TGCAGGACCAGAGAATTCGAATACAT GGCGTGCNNNGATCGACATG | 2298 | TGCAGGACCAGAGAATTCGAATACAT AGTATCANNNGATCGACATG | 2538 | TGCAGGACCAGAGAATTCGAATACAG TCCAGTANNNGATCGACATG | 2778 |
| TGCAGGACCAGAGAATTCGAATACAC CAGTGCGNNNGATCGACATG | 2299 | TGCAGGACCAGAGAATTCGAATACAC CTGACAANNNGATCGACATG | 2539 | TGCAGGACCAGAGAATTCGAATACAG GCGAGACNNNGATCGACATG | 2779 |
| TGCAGGACCAGAGAATTCGAATACAT GCCCCTGNNNGATCGACATG | 2300 | TGCAGGACCAGAGAATTCGAATACAC GTGGCCANNNGATCGACATG | 2540 | TGCAGGACCAGAGAATTCGAATACAT TTCATACNNNGATCGACATG | 2780 |
| TGCAGGACCAGAGAATTCGAATACAT CCGTCGCNNNGATCGACATG | 2301 | TGCAGGACCAGAGAATTCGAATACAG CGTATACNNNGATCGACATG | 2541 | TGCAGGACCAGAGAATTCGAATACAC AGCTGTANNNGATCGACATG | 2781 |
| TGCAGGACCAGAGAATTCGAATACAC TCCTCCGNNNGATCGACATG | 2302 | TGCAGGACCAGAGAATTCGAATACAG CGCTGCANNNGATCGACATG | 2542 | TGCAGGACCAGAGAATTCGAATACAA CTGCTCTNNNGATCGACATG | 2782 |
| TGCAGGACCAGAGAATTCGAATACAG CTCCATTNNNGATCGACATG | 2303 | TGCAGGACCAGAGAATTCGAATACAA CCGTTAGNNNGATCGACATG | 2543 | TGCAGGACCAGAGAATTCGAATACAA AAGTTCTNNNGATCGACATG | 2783 |
| TGCAGGACCAGAGAATTCGAATACAG ACTCCTTNNNGATCGACATG | 2304 | TGCAGGACCAGAGAATTCGAATACAT GTACTTTNNNGATCGACATG | 2544 | TGCAGGACCAGAGAATTCGAATACAG AATCGAGNNNGATCGACATG | 2784 |
| TGCAGGACCAGAGAATTCGAATACAT GTAACTANNNGATCGACATG | 2305 | TGCAGGACCAGAGAATTCGAATACAC ATTATGANNNGATCGACATG | 2545 | TGCAGGACCAGAGAATTCGAATACAC TCCCGCANNNGATCGACATG | 2785 |
| TGCAGGACCAGAGAATTCGAATACAA GAGTCTCNNNGATCGACATG | 2306 | TGCAGGACCAGAGAATTCGAATACAC AGACCCGNNNGATCGACATG | 2546 | TGCAGGACCAGAGAATTCGAATACAG AAAACTANNNGATCGACATG | 2786 |
| TGCAGGACCAGAGAATTCGAATACAC TTTCTAANNNGATCGACATG | 2307 | TGCAGGACCAGAGAATTCGAATACAT AGCACCANNNGATCGACATG | 2547 | TGCAGGACCAGAGAATTCGAATACAA CCCTAAGNNNGATCGACATG | 2787 |
| TGCAGGACCAGAGAATTCGAATACAC GAGACCCNNNGATCGACATG | 2308 | TGCAGGACCAGAGAATTCGAATACAT GGAGTGANNNGATCGACATG | 2548 | TGCAGGACCAGAGAATTCGAATACAG GTCATACNNNGATCGACATG | 2788 |
| TGCAGGACCAGAGAATTCGAATACAT TTTAGTCNNNGATCGACATG | 2309 | TGCAGGACCAGAGAATTCGAATACAG GACGTGNNNGATCGACATG | 2549 | TGCAGGACCAGAGAATTCGAATACAT GGTTGTGNNNGATCGACATG | 2789 |
| TGCAGGACCAGAGAATTCGAATACAA TGTGCTGNNNGATCGACATG | 2310 | TGCAGGACCAGAGAATTCGAATACAC CTTACACNNNGATCGACATG | 2550 | TGCAGGACCAGAGAATTCGAATACAA AGTTCCGNNNGATCGACATG | 2790 |
| TGCAGGACCAGAGAATTCGAATACAC CCAGGTGNNNGATCGACATG | 2311 | TGCAGGACCAGAGAATTCGAATACAT GGCAGCCNNNGATCGACATG | 2551 | TGCAGGACCAGAGAATTCGAATACAA TCAATGTNNNGATCGACATG | 2791 |
| TGCAGGACCAGAGAATTCGAATACAG AACCAAGNNNGATCGACATG | 2312 | TGCAGGACCAGAGAATTCGAATACAC CTTACTGNNNGATCGACATG | 2552 | TGCAGGACCAGAGAATTCGAATACAC ATTGATANNNGATCGACATG | 2792 |
| TGCAGGACCAGAGAATTCGAATACAC CTGAGGCNNNGATCGACATG | 2313 | TGCAGGACCAGAGAATTCGAATACAT TACTCTANNNGATCGACATG | 2553 | TGCAGGACCAGAGAATTCGAATACAG GAGGAAANNNGATCGACATG | 2793 |
| TGCAGGACCAGAGAATTCGAATACAA TAAGCGGNNNGATCGACATG | 2314 | TGCAGGACCAGAGAATTCGAATACAC CGCCTACNNNGATCGACATG | 2554 | TGCAGGACCAGAGAATTCGAATACAC ATTTTACNNNGATCGACATG | 2794 |
| TGCAGGACCAGAGAATTCGAATACAT TTGTCATNNNGATCGACATG | 2315 | TGCAGGACCAGAGAATTCGAATACAC CTTAGAGNNNGATCGACATG | 2555 | TGCAGGACCAGAGAATTCGAATACAG AACTTCGNNNGATCGACATG | 2795 |
| TGCAGGACCAGAGAATTCGAATACAA GCGTTTGNNNGATCGACATG | 2316 | TGCAGGACCAGAGAATTCGAATACAT TCTATGTNNNGATCGACATG | 2556 | TGCAGGACCAGAGAATTCGAATACAC GTCACCCNNNGATCGACATG | 2796 |
| TGCAGGACCAGAGAATTCGAATACAG CTATTTNNNGATCGACATG | 2317 | TGCAGGACCAGAGAATTCGAATACAT TTTACACNNNGATCGACATG | 2557 | TGCAGGACCAGAGAATTCGAATACAA CGTTAATNNNGATCGACATG | 2797 |
| TGCAGGACCAGAGAATTCGAATACAT GACACCANNNGATCGACATG | 2318 | TGCAGGACCAGAGAATTCGAATACAT TGTTTTGNNNGATCGACATG | 2558 | TGCAGGACCAGAGAATTCGAATACAG GTGTGTTNNNGATCGACATG | 2798 |
| TGCAGGACCAGAGAATTCGAATACAC GCTCAAANNNGATCGACATG | 2319 | TGCAGGACCAGAGAATTCGAATACAC AAAGACGNNNGATCGACATG | 2559 | TGCAGGACCAGAGAATTCGAATACAG AAATAGTNNNGATCGACATG | 2799 |
| TGCAGGACCAGAGAATTCGAATACAG CGCATTANNNGATCGACATG | 2320 | TGCAGGACCAGAGAATTCGAATACAA CCTCCGCNNNGATCGACATG | 2560 | TGCAGGACCAGAGAATTCGAATACAG TCTATTTNNNGATCGACATG | 2800 |
| TGCAGGACCAGAGAATTCGAATACAT CTAAATGNNNGATCGACATG | 2321 | TGCAGGACCAGAGAATTCGAATACAG TTAACATNNNGATCGACATG | 2561 | TGCAGGACCAGAGAATTCGAATACAT AGTAGCCNNNGATCGACATG | 2801 |
| TGCAGGACCAGAGAATTCGAATACAA GCACTACNNNGATCGACATG | 2322 | TGCAGGACCAGAGAATTCGAATACAC GATGCGCNNNGATCGACATG | 2562 | TGCAGGACCAGAGAATTCGAATACAG TACAAAANNNGATCGACATG | 2802 |
| TGCAGGACCAGAGAATTCGAATACAC ATTCAGNNNGATCGACATG | 2323 | TGCAGGACCAGAGAATTCGAATACAC CTCGAAANNNGATCGACATG | 2563 | TGCAGGACCAGAGAATTCGAATACAA GAGTACGNNNGATCGACATG | 2803 |
| TGCAGGACCAGAGAATTCGAATACAC TGCTCCGNNNGATCGACATG | 2324 | TGCAGGACCAGAGAATTCGAATACAA TGTCGACNNNGATCGACATG | 2564 | TGCAGGACCAGAGAATTCGAATACAT AGACTTANNNGATCGACATG | 2804 |
| TGCAGGACCAGAGAATTCGAATACAG CACGATTNNNGATCGACATG | 2325 | TGCAGGACCAGAGAATTCGAATACAT AACAGCCNNNGATCGACATG | 2565 | TGCAGGACCAGAGAATTCGAATACAG GAGCAAANNNGATCGACATG | 2805 |
| TGCAGGACCAGAGAATTCGAATACAA TGTCATANNNGATCGACATG | 2326 | TGCAGGACCAGAGAATTCGAATACAG CGCAGTCNNNGATCGACATG | 2566 | TGCAGGACCAGAGAATTCGAATACAA GCGTCGCNNNGATCGACATG | 2806 |
| TGCAGGACCAGAGAATTCGAATACAA CAGGACANNNGATCGACATG | 2327 | TGCAGGACCAGAGAATTCGAATACAA TCATAACNNNGATCGACATG | 2567 | TGCAGGACCAGAGAATTCGAATACAG CTGGTCGNNNGATCGACATG | 2807 |
| TGCAGGACCAGAGAATTCGAATACAC CGTAAGTNNNGATCGACATG | 2328 | TGCAGGACCAGAGAATTCGAATACAA AGGTCTCNNNGATCGACATG | 2568 | TGCAGGACCAGAGAATTCGAATACAA GTCCACANNNGATCGACATG | 2808 |

FIG. 15F

| Pool-10 | SEQ ID NO: | Pool-11 | SEQ ID NO: | Pool-12 | SEQ ID NO: |
|---|---|---|---|---|---|
| TGCAGGACCAGAGAATTCGAATACAAAAGAATCNNNGATCGACATG | 2329 | TGCAGGACCAGAGAATTCGAATACAGAAATACANNNGATCGACATG | 2569 | TGCAGGACCAGAGAATTCGAATACATCCCTTAGNNNGATCGACATG | 2809 |
| TGCAGGACCAGAGAATTCGAATACACAAGCCTANNNGATCGACATG | 2330 | TGCAGGACCAGAGAATTCGAATACAACGTACTGNNNGATCGACATG | 2570 | TGCAGGACCAGAGAATTCGAATACACCGGATGCNNNGATCGACATG | 2810 |
| TGCAGGACCAGAGAATTCGAATACACTAACTAANNNGATCGACATG | 2331 | TGCAGGACCAGAGAATTCGAATACAATTAAGTCNNNGATCGACATG | 2571 | TGCAGGACCAGAGAATTCGAATACATCTATATCNNNGATCGACATG | 2811 |
| TGCAGGACCAGAGAATTCGAATACACGCGTAATNNNGATCGACATG | 2332 | TGCAGGACCAGAGAATTCGAATACACGTGAAAGNNNGATCGACATG | 2572 | TGCAGGACCAGAGAATTCGAATACAAGACCCTANNNGATCGACATG | 2812 |
| TGCAGGACCAGAGAATTCGAATACAGACGTCTTNNNGATCGACATG | 2333 | TGCAGGACCAGAGAATTCGAATACAGGTTAATNNNGATCGACATG | 2573 | TGCAGGACCAGAGAATTCGAATACAGGCTGGTCNNNGATCGACATG | 2813 |
| TGCAGGACCAGAGAATTCGAATACAAGCCCGTNNNGATCGACATG | 2334 | TGCAGGACCAGAGAATTCGAATACAGGACAGGTNNNGATCGACATG | 2574 | TGCAGGACCAGAGAATTCGAATACAGACGATGANNNGATCGACATG | 2814 |
| TGCAGGACCAGAGAATTCGAATACAGCTCAACANNNGATCGACATG | 2335 | TGCAGGACCAGAGAATTCGAATACACCCAGTGNNNGATCGACATG | 2575 | TGCAGGACCAGAGAATTCGAATACAGCCCATAANNNGATCGACATG | 2815 |
| TGCAGGACCAGAGAATTCGAATACAATCAGGAGNNNGATCGACATG | 2336 | TGCAGGACCAGAGAATTCGAATACATCCAAGGTNNNGATCGACATG | 2576 | TGCAGGACCAGAGAATTCGAATACAACTTTCATNNNGATCGACATG | 2816 |
| TGCAGGACCAGAGAATTCGAATACACCCCAGAGNNNGATCGACATG | 2337 | TGCAGGACCAGAGAATTCGAATACATGAGTATTNNNGATCGACATG | 2577 | TGCAGGACCAGAGAATTCGAATACATCGACTTCNNNGATCGACATG | 2817 |
| TGCAGGACCAGAGAATTCGAATACAGAGGTGGCNNNGATCGACATG | 2338 | TGCAGGACCAGAGAATTCGAATACATGTACGGTNNNGATCGACATG | 2578 | TGCAGGACCAGAGAATTCGAATACACGCTACTTNNNGATCGACATG | 2818 |
| TGCAGGACCAGAGAATTCGAATACACCCAAGCCNNNGATCGACATG | 2339 | TGCAGGACCAGAGAATTCGAATACACGCGTCAGNNNGATCGACATG | 2579 | TGCAGGACCAGAGAATTCGAATACACGAAAACGNNNGATCGACATG | 2819 |
| TGCAGGACCAGAGAATTCGAATACACTGGTGGCNNNGATCGACATG | 2340 | TGCAGGACCAGAGAATTCGAATACACGGATGTNNNGATCGACATG | 2580 | TGCAGGACCAGAGAATTCGAATACATTATGCGNNNGATCGACATG | 2820 |
| TGCAGGACCAGAGAATTCGAATACACGTATGTNNNGATCGACATG | 2341 | TGCAGGACCAGAGAATTCGAATACACACAAGGTNNNGATCGACATG | 2581 | TGCAGGACCAGAGAATTCGAATACAGCTATTANNNGATCGACATG | 2821 |
| TGCAGGACCAGAGAATTCGAATACATGCGTTTCNNNGATCGACATG | 2342 | TGCAGGACCAGAGAATTCGAATACAATTAAAAANNNGATCGACATG | 2582 | TGCAGGACCAGAGAATTCGAATACAGGCCCGCGNNNGATCGACATG | 2822 |
| TGCAGGACCAGAGAATTCGAATACATAAATTTANNNGATCGACATG | 2343 | TGCAGGACCAGAGAATTCGAATACAACGACCCGNNNGATCGACATG | 2583 | TGCAGGACCAGAGAATTCGAATACAGACGCTGCNNNGATCGACATG | 2823 |
| TGCAGGACCAGAGAATTCGAATACATCGGACATNNNGATCGACATG | 2344 | TGCAGGACCAGAGAATTCGAATACATCAAACTANNNGATCGACATG | 2584 | TGCAGGACCAGAGAATTCGAATACAGCGAGCCCNNNGATCGACATG | 2824 |
| TGCAGGACCAGAGAATTCGAATACATAAACACTNNNGATCGACATG | 2345 | TGCAGGACCAGAGAATTCGAATACACACGCCGANNNGATCGACATG | 2585 | TGCAGGACCAGAGAATTCGAATACATTCATCGCNNNGATCGACATG | 2825 |
| TGCAGGACCAGAGAATTCGAATACATTAGGCCANNNGATCGACATG | 2346 | TGCAGGACCAGAGAATTCGAATACACGATCAGTNNNGATCGACATG | 2586 | TGCAGGACCAGAGAATTCGAATACACATAAAAGNNNGATCGACATG | 2826 |
| TGCAGGACCAGAGAATTCGAATACAAGCCCTCCNNNGATCGACATG | 2347 | TGCAGGACCAGAGAATTCGAATACACACTTTGCNNNGATCGACATG | 2587 | TGCAGGACCAGAGAATTCGAATACACTCGCGCTNNNGATCGACATG | 2827 |
| TGCAGGACCAGAGAATTCGAATACACGGAAAACNNNGATCGACATG | 2348 | TGCAGGACCAGAGAATTCGAATACATCCTGATCNNNGATCGACATG | 2588 | TGCAGGACCAGAGAATTCGAATACAGACATGTCNNNGATCGACATG | 2828 |
| TGCAGGACCAGAGAATTCGAATACAGGCCGGTTNNNTGCATCAGGT | 2349 | TGCAGGACCAGAGAATTCGAATACAGAACTCCANNNTGCATCAGGT | 2589 | TGCAGGACCAGAGAATTCGAATACACTCACCGCNNNTGCATCAGGT | 2829 |
| TGCAGGACCAGAGAATTCGAATACATAGGCTACNNNTGCATCAGGT | 2350 | TGCAGGACCAGAGAATTCGAATACAGGTCAATCNNNTGCATCAGGT | 2590 | TGCAGGACCAGAGAATTCGAATACACACGTCTTNNNTGCATCAGGT | 2830 |
| TGCAGGACCAGAGAATTCGAATACACCACTTGTNNNTGCATCAGGT | 2351 | TGCAGGACCAGAGAATTCGAATACATATGCAGCNNNTGCATCAGGT | 2591 | TGCAGGACCAGAGAATTCGAATACAACTGCGTANNNTGCATCAGGT | 2831 |
| TGCAGGACCAGAGAATTCGAATACAGATAGAGCNNNTGCATCAGGT | 2352 | TGCAGGACCAGAGAATTCGAATACAGCACCTCCNNNTGCATCAGGT | 2592 | TGCAGGACCAGAGAATTCGAATACATAAATTATNNNTGCATCAGGT | 2832 |
| TGCAGGACCAGAGAATTCGAATACAAGTCCAGTNNNTGCATCAGGT | 2353 | TGCAGGACCAGAGAATTCGAATACATCAAGTGCNNNTGCATCAGGT | 2593 | TGCAGGACCAGAGAATTCGAATACATAGTCTAANNNTGCATCAGGT | 2833 |
| TGCAGGACCAGAGAATTCGAATACAGTCATCAGNNNTGCATCAGGT | 2354 | TGCAGGACCAGAGAATTCGAATACATTGCCGTTNNNTGCATCAGGT | 2594 | TGCAGGACCAGAGAATTCGAATACACAAACTATNNNTGCATCAGGT | 2834 |
| TGCAGGACCAGAGAATTCGAATACATTTCGGAGNNNTGCATCAGGT | 2355 | TGCAGGACCAGAGAATTCGAATACAGTGGAGTANNNTGCATCAGGT | 2595 | TGCAGGACCAGAGAATTCGAATACATCACTGTCNNNTGCATCAGGT | 2835 |
| TGCAGGACCAGAGAATTCGAATACACTCAGGATNNNTGCATCAGGT | 2356 | TGCAGGACCAGAGAATTCGAATACAGCCTCACCNNNTGCATCAGGT | 2596 | TGCAGGACCAGAGAATTCGAATACAACAAATGNNNTGCATCAGGT | 2836 |
| TGCAGGACCAGAGAATTCGAATACACCTATCCANNNTGCATCAGGT | 2357 | TGCAGGACCAGAGAATTCGAATACACACACCANNNTGCATCAGGT | 2597 | TGCAGGACCAGAGAATTCGAATACATTTTCTTCNNNTGCATCAGGT | 2837 |
| TGCAGGACCAGAGAATTCGAATACAAATGCTGNNNTGCATCAGGT | 2358 | TGCAGGACCAGAGAATTCGAATACAACCCCATTNNNTGCATCAGGT | 2598 | TGCAGGACCAGAGAATTCGAATACACTTCAGTCNNNTGCATCAGGT | 2838 |
| TGCAGGACCAGAGAATTCGAATACAGGTGAAANNNTGCATCAGGT | 2359 | TGCAGGACCAGAGAATTCGAATACAATAGTCTANNNTGCATCAGGT | 2599 | TGCAGGACCAGAGAATTCGAATACAGGTCTGTNNNTGCATCAGGT | 2839 |
| TGCAGGACCAGAGAATTCGAATACAGTTGCAACNNNTGCATCAGGT | 2360 | TGCAGGACCAGAGAATTCGAATACAGAATGTCCNNNTGCATCAGGT | 2600 | TGCAGGACCAGAGAATTCGAATACAGCAAACAGNNNTGCATCAGGT | 2840 |

FIG. 15G

| Pool-10 | SEQ ID NO: | Pool-11 | SEQ ID NO: | Pool-12 | SEQ ID NO: |
|---|---|---|---|---|---|
| TGCAGGACCAGAGAATTCGAATACAGAGAGCTANNNTGCATCAGGT | 2361 | TGCAGGACCAGAGAATTCGAATACACTAGATCGNNNTGCATCAGGT | 2601 | TGCAGGACCAGAGAATTCGAATACACCGAGAGGNNNTGCATCAGGT | 2841 |
| TGCAGGACCAGAGAATTCGAATACAGCCTAACANNNTGCATCAGGT | 2362 | TGCAGGACCAGAGAATTCGAATACACGCAACCCNNNTGCATCAGGT | 2602 | TGCAGGACCAGAGAATTCGAATACAATATTGCANNNTGCATCAGGT | 2842 |
| TGCAGGACCAGAGAATTCGAATACACTGAGACTNNNTGCATCAGGT | 2363 | TGCAGGACCAGAGAATTCGAATACAGGAGAGAANNNTGCATCAGGT | 2603 | TGCAGGACCAGAGAATTCGAATACATCTCTGGTNNNTGCATCAGGT | 2843 |
| TGCAGGACCAGAGAATTCGAATACAACGTTGCANNNTGCATCAGGT | 2364 | TGCAGGACCAGAGAATTCGAATACAGTTGTCCTNNNTGCATCAGGT | 2604 | TGCAGGACCAGAGAATTCGAATACAATTGGAGGNNNTGCATCAGGT | 2844 |
| TGCAGGACCAGAGAATTCGAATACAGGAAGCTANNNTGCATCAGGT | 2365 | TGCAGGACCAGAGAATTCGAATACATGGCATACNNNTGCATCAGGT | 2605 | TGCAGGACCAGAGAATTCGAATACACATCATTTNNNTGCATCAGGT | 2845 |
| TGCAGGACCAGAGAATTCGAATACACCCTGTATNNNTGCATCAGGT | 2366 | TGCAGGACCAGAGAATTCGAATACAGAGGCAATNNNTGCATCAGGT | 2606 | TGCAGGACCAGAGAATTCGAATACAGAGGTGATNNNTGCATCAGGT | 2846 |
| TGCAGGACCAGAGAATTCGAATACATAGCCTCTNNNTGCATCAGGT | 2367 | TGCAGGACCAGAGAATTCGAATACATCTCACGTNNNTGCATCAGGT | 2607 | TGCAGGACCAGAGAATTCGAATACACCCCGTCANNNTGCATCAGGT | 2847 |
| TGCAGGACCAGAGAATTCGAATACAAGGTACCTNNNTGCATCAGGT | 2368 | TGCAGGACCAGAGAATTCGAATACACTGCGGCANNNTGCATCAGGT | 2608 | TGCAGGACCAGAGAATTCGAATACAGACAGGTANNNTGCATCAGGT | 2848 |
| TGCAGGACCAGAGAATTCGAATACATGTTATCTNNNTGCATCAGGT | 2369 | TGCAGGACCAGAGAATTCGAATACACTTAATGANNNTGCATCAGGT | 2609 | TGCAGGACCAGAGAATTCGAATACAGCCTTAGANNNTGCATCAGGT | 2849 |
| TGCAGGACCAGAGAATTCGAATACAGACTTACGNNNTGCATCAGGT | 2370 | TGCAGGACCAGAGAATTCGAATACAAACTCACGNNNTGCATCAGGT | 2610 | TGCAGGACCAGAGAATTCGAATACACCTTCTAGNNNTGCATCAGGT | 2850 |
| TGCAGGACCAGAGAATTCGAATACAACTTCCACNNNTGCATCAGGT | 2371 | TGCAGGACCAGAGAATTCGAATACAAGCAGTGANNNTGCATCAGGT | 2611 | TGCAGGACCAGAGAATTCGAATACAAGGCTTGTNNNTGCATCAGGT | 2851 |
| TGCAGGACCAGAGAATTCGAATACACCTTCTGANNNTGCATCAGGT | 2372 | TGCAGGACCAGAGAATTCGAATACATAATACTGNNNTGCATCAGGT | 2612 | TGCAGGACCAGAGAATTCGAATACATGGAGTTCNNNTGCATCAGGT | 2852 |
| TGCAGGACCAGAGAATTCGAATACACGACACTANNNTGCATCAGGT | 2373 | TGCAGGACCAGAGAATTCGAATACAAAGTCCCNNNTGCATCAGGT | 2613 | TGCAGGACCAGAGAATTCGAATACACCACCGAGNNNTGCATCAGGT | 2853 |
| TGCAGGACCAGAGAATTCGAATACACTGTGAGTNNNTGCATCAGGT | 2374 | TGCAGGACCAGAGAATTCGAATACAGCTGGAANNNTGCATCAGGT | 2614 | TGCAGGACCAGAGAATTCGAATACAGGAATGCANNNTGCATCAGGT | 2854 |
| TGCAGGACCAGAGAATTCGAATACAAGAGACACNNNTGCATCAGGT | 2375 | TGCAGGACCAGAGAATTCGAATACAAAGAGGAGNNNTGCATCAGGT | 2615 | TGCAGGACCAGAGAATTCGAATACAACATTACANNNTGCATCAGGT | 2855 |
| TGCAGGACCAGAGAATTCGAATACATAATTGTGNNNTGCATCAGGT | 2376 | TGCAGGACCAGAGAATTCGAATACAGTGGAAGTNNNTGCATCAGGT | 2616 | TGCAGGACCAGAGAATTCGAATACAAGTCTCTNNNTGCATCAGGT | 2856 |
| TGCAGGACCAGAGAATTCGAATACAGTAATTGNNNTGCATCAGGT | 2377 | TGCAGGACCAGAGAATTCGAATACACGGGACTNNNTGCATCAGGT | 2617 | TGCAGGACCAGAGAATTCGAATACATAGTGCCANNNTGCATCAGGT | 2857 |
| TGCAGGACCAGAGAATTCGAATACACATACTATNNNTGCATCAGGT | 2378 | TGCAGGACCAGAGAATTCGAATACATACTTGTNNNTGCATCAGGT | 2618 | TGCAGGACCAGAGAATTCGAATACAGCAATGCTNNNTGCATCAGGT | 2858 |
| TGCAGGACCAGAGAATTCGAATACAAGTGGATNNNTGCATCAGGT | 2379 | TGCAGGACCAGAGAATTCGAATACAABCTGACCNNNTGCATCAGGT | 2619 | TGCAGGACCAGAGAATTCGAATACAGTTGAATNNNTGCATCAGGT | 2859 |
| TGCAGGACCAGAGAATTCGAATACATTATAGACNNNTGCATCAGGT | 2380 | TGCAGGACCAGAGAATTCGAATACATGCTGGTANNNTGCATCAGGT | 2620 | TGCAGGACCAGAGAATTCGAATACACCACTTCANNNTGCATCAGGT | 2860 |
| TGCAGGACCAGAGAATTCGAATACAGAGTTTCGNNNTGCATCAGGT | 2381 | TGCAGGACCAGAGAATTCGAATACAATATTTTNNNTGCATCAGGT | 2621 | TGCAGGACCAGAGAATTCGAATACATCCATTCGNNNTGCATCAGGT | 2861 |
| TGCAGGACCAGAGAATTCGAATACACAGAGATGNNNTGCATCAGGT | 2382 | TGCAGGACCAGAGAATTCGAATACATCCCCATANNNTGCATCAGGT | 2622 | TGCAGGACCAGAGAATTCGAATACACACTCTCANNNTGCATCAGGT | 2862 |
| TGCAGGACCAGAGAATTCGAATACAGACTCAACNNNTGCATCAGGT | 2383 | TGCAGGACCAGAGAATTCGAATACACAAGTTGCNNNTGCATCAGGT | 2623 | TGCAGGACCAGAGAATTCGAATACAGACCTGATNNNTGCATCAGGT | 2863 |
| TGCAGGACCAGAGAATTCGAATACATTCGCTGTNNNTGCATCAGGT | 2384 | TGCAGGACCAGAGAATTCGAATACATGAACCGTNNNTGCATCAGGT | 2624 | TGCAGGACCAGAGAATTCGAATACAAGAGCTCNNNTGCATCAGGT | 2864 |
| TGCAGGACCAGAGAATTCGAATACACGTCCGAGNNNTGCATCAGGT | 2385 | TGCAGGACCAGAGAATTCGAATACACGCATTGANNNTGCATCAGGT | 2625 | TGCAGGACCAGAGAATTCGAATACACTGGATTGNNNTGCATCAGGT | 2865 |
| TGCAGGACCAGAGAATTCGAATACAGCATGCATNNNTGCATCAGGT | 2386 | TGCAGGACCAGAGAATTCGAATACAGGCGTTGNNNTGCATCAGGT | 2626 | TGCAGGACCAGAGAATTCGAATACATGCTATCGNNNTGCATCAGGT | 2866 |
| TGCAGGACCAGAGAATTCGAATACAAAGTGCCNNNTGCATCAGGT | 2387 | TGCAGGACCAGAGAATTCGAATACACCCGCCCGNNNTGCATCAGGT | 2627 | TGCAGGACCAGAGAATTCGAATACAGACGTTGTNNNTGCATCAGGT | 2867 |
| TGCAGGACCAGAGAATTCGAATACAGAAAGCACNNNTGCATCAGGT | 2388 | TGCAGGACCAGAGAATTCGAATACACAAGCTACNNNTGCATCAGGT | 2628 | TGCAGGACCAGAGAATTCGAATACAATTCATCTNNNTGCATCAGGT | 2868 |
| TGCAGGACCAGAGAATTCGAATACAGGCTGCTGNNNTGCATCAGGT | 2389 | TGCAGGACCAGAGAATTCGAATACACGGTTCANNNTGCATCAGGT | 2629 | TGCAGGACCAGAGAATTCGAATACACGATTCAGNNNTGCATCAGGT | 2869 |
| TGCAGGACCAGAGAATTCGAATACAGCGGAAGCNNNTGCATCAGGT | 2390 | TGCAGGACCAGAGAATTCGAATACACAACGTTGNNNTGCATCAGGT | 2630 | TGCAGGACCAGAGAATTCGAATACATGGTGCATNNNTGCATCAGGT | 2870 |
| TGCAGGACCAGAGAATTCGAATACATCACATANNNTGCATCAGGT | 2391 | TGCAGGACCAGAGAATTCGAATACAGTACTAGCNNNTGCATCAGGT | 2631 | TGCAGGACCAGAGAATTCGAATACATGTGTTTTNNNTGCATCAGGT | 2871 |
| TGCAGGACCAGAGAATTCGAATACAACTCTCTGNNNTGCATCAGGT | 2392 | TGCAGGACCAGAGAATTCGAATACATGAGTGTCNNNTGCATCAGGT | 2632 | TGCAGGACCAGAGAATTCGAATACATGGCATCANNNTGCATCAGGT | 2872 |

FIG. 15H

| Pool-10 | SEQ ID NO: | Pool-11 | SEQ ID NO: | Pool-12 | SEQ ID NO: |
|---|---|---|---|---|---|
| TGCAGGACCAGAGAATTCGAATACACGCCCCGNNNTGCATCAGGT | 2393 | TGCAGGACCAGAGAATTCGAATACACAAACAGGNNNTGCATCAGGT | 2633 | TGCAGGACCAGAGAATTCGAATACATAAGCTGCNNNTGCATCAGGT | 2873 |
| TGCAGGACCAGAGAATTCGAATACATTTAATCCNNNTGCATCAGGT | 2394 | TGCAGGACCAGAGAATTCGAATACAGCATGCTANNNTGCATCAGGT | 2634 | TGCAGGACCAGAGAATTCGAATACAACGGACTTNNNTGCATCAGGT | 2874 |
| TGCAGGACCAGAGAATTCGAATACACCGTCGGANNNTGCATCAGGT | 2395 | TGCAGGACCAGAGAATTCGAATACAGATTCACGNNNTGCATCAGGT | 2635 | TGCAGGACCAGAGAATTCGAATACATGAATTACNNNTGCATCAGGT | 2875 |
| TGCAGGACCAGAGAATTCGAATACATGAGAAATNNNTGCATCAGGT | 2396 | TGCAGGACCAGAGAATTCGAATACAGTAGATCCNNNTGCATCAGGT | 2636 | TGCAGGACCAGAGAATTCGAATACAAACAGAGCNNNTGCATCAGGT | 2876 |
| TGCAGGACCAGAGAATTCGAATACACGTTATAANNNTGCATCAGGT | 2397 | TGCAGGACCAGAGAATTCGAATACAGGCCAACGNNNTGCATCAGGT | 2637 | TGCAGGACCAGAGAATTCGAATACACATGTTCCNNNTGCATCAGGT | 2877 |
| TGCAGGACCAGAGAATTCGAATACATCTAAAACNNNTGCATCAGGT | 2398 | TGCAGGACCAGAGAATTCGAATACAGAGCATAGNNNTGCATCAGGT | 2638 | TGCAGGACCAGAGAATTCGAATACATCGTCTACNNNTGCATCAGGT | 2878 |
| TGCAGGACCAGAGAATTCGAATACAACACTCGANNNTGCATCAGGT | 2399 | TGCAGGACCAGAGAATTCGAATACAGGTGTCATNNNTGCATCAGGT | 2639 | TGCAGGACCAGAGAATTCGAATACATAGAGACNNNTGCATCAGGT | 2879 |
| TGCAGGACCAGAGAATTCGAATACAGCATCGTANNNTGCATCAGGT | 2400 | TGCAGGACCAGAGAATTCGAATACATCTTCGACNNNTGCATCAGGT | 2640 | TGCAGGACCAGAGAATTCGAATACATATAGTGTNNNTGCATCAGGT | 2880 |
| TGCAGGACCAGAGAATTCGAATACAGTAAGACGNNNTGCATCAGGT | 2401 | TGCAGGACCAGAGAATTCGAATACAGATCAGCTNNNTGCATCAGGT | 2641 | TGCAGGACCAGAGAATTCGAATACAGGAGAGTTNNNTGCATCAGGT | 2881 |
| TGCAGGACCAGAGAATTCGAATACAAAAGCCCTNNNTGCATCAGGT | 2402 | TGCAGGACCAGAGAATTCGAATACATCGACCTTNNNTGCATCAGGT | 2642 | TGCAGGACCAGAGAATTCGAATACATACATTCTNNNTGCATCAGGT | 2882 |
| TGCAGGACCAGAGAATTCGAATACACCATGGTANNNTGCATCAGGT | 2403 | TGCAGGACCAGAGAATTCGAATACAAGCCCACGNNNTGCATCAGGT | 2643 | TGCAGGACCAGAGAATTCGAATACACACAATGCNNNTGCATCAGGT | 2883 |
| TGCAGGACCAGAGAATTCGAATACACGAAATAANNNTGCATCAGGT | 2404 | TGCAGGACCAGAGAATTCGAATACAGAGATCTCNNNTGCATCAGGT | 2644 | TGCAGGACCAGAGAATTCGAATACAGATATTACNNNTGCATCAGGT | 2884 |
| TGCAGGACCAGAGAATTCGAATACAGATCAAAANNNTGCATCAGGT | 2405 | TGCAGGACCAGAGAATTCGAATACATCTTTAACNNNTGCATCAGGT | 2645 | TGCAGGACCAGAGAATTCGAATACACGGCTTTTNNNTGCATCAGGT | 2885 |
| TGCAGGACCAGAGAATTCGAATACAAGTGCCGCNNNTGCATCAGGT | 2406 | TGCAGGACCAGAGAATTCGAATACATCCCTAACNNNTGCATCAGGT | 2646 | TGCAGGACCAGAGAATTCGAATACAGCTGCTGGNNNTGCATCAGGT | 2886 |
| TGCAGGACCAGAGAATTCGAATACACCCTGGCTNNNTGCATCAGGT | 2407 | TGCAGGACCAGAGAATTCGAATACAACTCGACANNNTGCATCAGGT | 2647 | TGCAGGACCAGAGAATTCGAATACAAAGGCGCGNNNTGCATCAGGT | 2887 |
| TGCAGGACCAGAGAATTCGAATACACAAGTTCGNNNTGCATCAGGT | 2408 | TGCAGGACCAGAGAATTCGAATACATGAGAGACNNNTGCATCAGGT | 2648 | TGCAGGACCAGAGAATTCGAATACAACGGTGAANNNTGCATCAGGT | 2888 |

FIG. 16A

| Pool-13 | SEQ ID NO: | Pool-14 | SEQ ID NO: | Pool-15 | SEQ ID NO: |
|---|---|---|---|---|---|
| TGCAGGACCAGAGAATTCGAATACAC CACGGACNNNACGTATGCCA | 2889 | TGCAGGACCAGAGAATTCGAATACAC ATGCGTANNNACGTATGCCA | 3129 | TGCAGGACCAGAGAATTCGAATACAG TGTGATCNNNACGTATGCCA | 3369 |
| TGCAGGACCAGAGAATTCGAATACAA ATCCTCCNNNACGTATGCCA | 2890 | TGCAGGACCAGAGAATTCGAATACAT CGTGCGGNNNACGTATGCCA | 3130 | TGCAGGACCAGAGAATTCGAATACAA AAGCGCANNNACGTATGCCA | 3370 |
| TGCAGGACCAGAGAATTCGAATACAG TGGCCGTNNNACGTATGCCA | 2891 | TGCAGGACCAGAGAATTCGAATACAG TAGTGGANNNACGTATGCCA | 3131 | TGCAGGACCAGAGAATTCGAATACAT CGTGGATNNNACGTATGCCA | 3371 |
| TGCAGGACCAGAGAATTCGAATACAA GAGTAGCNNNACGTATGCCA | 2892 | TGCAGGACCAGAGAATTCGAATACAA TTGTTGGNNNACGTATGCCA | 3132 | TGCAGGACCAGAGAATTCGAATACAT CACCGAANNNACGTATGCCA | 3372 |
| TGCAGGACCAGAGAATTCGAATACAT CCTGCGCNNNACGTATGCCA | 2893 | TGCAGGACCAGAGAATTCGAATACAA GAGCTTCNNNACGTATGCCA | 3133 | TGCAGGACCAGAGAATTCGAATACAG CCGTTGGNNNACGTATGCCA | 3373 |
| TGCAGGACCAGAGAATTCGAATACAT TCTCGTGNNNACGTATGCCA | 2894 | TGCAGGACCAGAGAATTCGAATACAG TACTGTGNNNACGTATGCCA | 3134 | TGCAGGACCAGAGAATTCGAATACAA CACGGTNNNACGTATGCCA | 3374 |
| TGCAGGACCAGAGAATTCGAATACAT GGTATGCNNNACGTATGCCA | 2895 | TGCAGGACCAGAGAATTCGAATACAA GCAACCTNNNACGTATGCCA | 3135 | TGCAGGACCAGAGAATTCGAATACAG CTCACGGNNNACGTATGCCA | 3375 |
| TGCAGGACCAGAGAATTCGAATACAA TCACTCCNNNACGTATGCCA | 2896 | TGCAGGACCAGAGAATTCGAATACAG CCCTGCTNNNACGTATGCCA | 3136 | TGCAGGACCAGAGAATTCGAATACAC AATCGCANNNACGTATGCCA | 3376 |
| TGCAGGACCAGAGAATTCGAATACAA ACAAGGCNNNACGTATGCCA | 2897 | TGCAGGACCAGAGAATTCGAATACAC TCTCGCGNNNACGTATGCCA | 3137 | TGCAGGACCAGAGAATTCGAATACAT AATATATNNNACGTATGCCA | 3377 |
| TGCAGGACCAGAGAATTCGAATACAC CGTCTTANNNACGTATGCCA | 2898 | TGCAGGACCAGAGAATTCGAATACAC TACTTGCNNNACGTATGCCA | 3138 | TGCAGGACCAGAGAATTCGAATACAC ATTACCCNNNACGTATGCCA | 3378 |
| TGCAGGACCAGAGAATTCGAATACAA AAAATTANNNACGTATGCCA | 2899 | TGCAGGACCAGAGAATTCGAATACAA TAATGAGNNNACGTATGCCA | 3139 | TGCAGGACCAGAGAATTCGAATACAG ACTACTGNNNACGTATGCCA | 3379 |
| TGCAGGACCAGAGAATTCGAATACAA CACAGAGNNNACGTATGCCA | 2900 | TGCAGGACCAGAGAATTCGAATACAC CGTAGTANNNACGTATGCCA | 3140 | TGCAGGACCAGAGAATTCGAATACAG TGCCGCNNNACGTATGCCA | 3380 |
| TGCAGGACCAGAGAATTCGAATACAA GTGCGCTNNNACGTATGCCA | 2901 | TGCAGGACCAGAGAATTCGAATACAC GCAACAGNNNACGTATGCCA | 3141 | TGCAGGACCAGAGAATTCGAATACAG GCTATTGNNNACGTATGCCA | 3381 |
| TGCAGGACCAGAGAATTCGAATACAC GTGACGCNNNACGTATGCCA | 2902 | TGCAGGACCAGAGAATTCGAATACAC TGTGTCTNNNACGTATGCCA | 3142 | TGCAGGACCAGAGAATTCGAATACAG GTGGTGGNNNACGTATGCCA | 3382 |
| TGCAGGACCAGAGAATTCGAATACAG ACCCCCTNNNACGTATGCCA | 2903 | TGCAGGACCAGAGAATTCGAATACAT CCAAACGNNNACGTATGCCA | 3143 | TGCAGGACCAGAGAATTCGAATACAT GCGTACANNNACGTATGCCA | 3383 |
| TGCAGGACCAGAGAATTCGAATACAA CATTTGANNNACGTATGCCA | 2904 | TGCAGGACCAGAGAATTCGAATACAT GTCAAGCNNNACGTATGCCA | 3144 | TGCAGGACCAGAGAATTCGAATACAA TTCTTCANNNACGTATGCCA | 3384 |
| TGCAGGACCAGAGAATTCGAATACAG GTGGCAGNNNACGTATGCCA | 2905 | TGCAGGACCAGAGAATTCGAATACAA GTGTCACNNNACGTATGCCA | 3145 | TGCAGGACCAGAGAATTCGAATACAT CTGGTCTNNNACGTATGCCA | 3385 |
| TGCAGGACCAGAGAATTCGAATACAG AGGCCAGNNNACGTATGCCA | 2906 | TGCAGGACCAGAGAATTCGAATACAC CTCAAGANNNACGTATGCCA | 3146 | TGCAGGACCAGAGAATTCGAATACAG CGAGCCTNNNACGTATGCCA | 3386 |
| TGCAGGACCAGAGAATTCGAATACAA CTCGAGTNNNACGTATGCCA | 2907 | TGCAGGACCAGAGAATTCGAATACAG TGAAAGCNNNACGTATGCCA | 3147 | TGCAGGACCAGAGAATTCGAATACAA GCCGTGCNNNACGTATGCCA | 3387 |
| TGCAGGACCAGAGAATTCGAATACAA CAAAAGGNNNACGTATGCCA | 2908 | TGCAGGACCAGAGAATTCGAATACAT TGCGCCNNNACGTATGCCA | 3148 | TGCAGGACCAGAGAATTCGAATACAG ATAACCCNNNACGTATGCCA | 3388 |
| TGCAGGACCAGAGAATTCGAATACAA AGCAACGNNNACGTATGCCA | 2909 | TGCAGGACCAGAGAATTCGAATACAG TATTGCGNNNACGTATGCCA | 3149 | TGCAGGACCAGAGAATTCGAATACAC GGAACCCNNNACGTATGCCA | 3389 |
| TGCAGGACCAGAGAATTCGAATACAG GCTTTGTNNNACGTATGCCA | 2910 | TGCAGGACCAGAGAATTCGAATACAA CAAATAGNNNACGTATGCCA | 3150 | TGCAGGACCAGAGAATTCGAATACAG TCCAGCGNNNACGTATGCCA | 3390 |
| TGCAGGACCAGAGAATTCGAATACAT GGATGCTNNNACGTATGCCA | 2911 | TGCAGGACCAGAGAATTCGAATACAC TACGCGGNNNACGTATGCCA | 3151 | TGCAGGACCAGAGAATTCGAATACAC GTGAGCCNNNACGTATGCCA | 3391 |
| TGCAGGACCAGAGAATTCGAATACAT CAATGGCNNNACGTATGCCA | 2912 | TGCAGGACCAGAGAATTCGAATACAT GTATACANNNACGTATGCCA | 3152 | TGCAGGACCAGAGAATTCGAATACAT CGGCCAGNNNACGTATGCCA | 3392 |
| TGCAGGACCAGAGAATTCGAATACAA ACTACTANNNACGTATGCCA | 2913 | TGCAGGACCAGAGAATTCGAATACAA GACCTACNNNACGTATGCCA | 3153 | TGCAGGACCAGAGAATTCGAATACAC CGGCAAGNNNACGTATGCCA | 3393 |
| TGCAGGACCAGAGAATTCGAATACAT TGCGATGNNNACGTATGCCA | 2914 | TGCAGGACCAGAGAATTCGAATACAT TCCCATGNNNACGTATGCCA | 3154 | TGCAGGACCAGAGAATTCGAATACAG GCTGTTANNNACGTATGCCA | 3394 |
| TGCAGGACCAGAGAATTCGAATACAG AGATACGNNNACGTATGCCA | 2915 | TGCAGGACCAGAGAATTCGAATACAT AGCCCTNNNACGTATGCCA | 3155 | TGCAGGACCAGAGAATTCGAATACAT GAAAATGNNNACGTATGCCA | 3395 |
| TGCAGGACCAGAGAATTCGAATACAT CCTTTTTNNNACGTATGCCA | 2916 | TGCAGGACCAGAGAATTCGAATACAG GTTCACNNNACGTATGCCA | 3156 | TGCAGGACCAGAGAATTCGAATACAC TTCTATANNNACGTATGCCA | 3396 |
| TGCAGGACCAGAGAATTCGAATACAG TTAGCGTNNNACGTATGCCA | 2917 | TGCAGGACCAGAGAATTCGAATACAG ACGTTGNNNACGTATGCCA | 3157 | TGCAGGACCAGAGAATTCGAATACAT CCCCGCANNNACGTATGCCA | 3397 |
| TGCAGGACCAGAGAATTCGAATACAG CGGCGCCNNNACGTATGCCA | 2918 | TGCAGGACCAGAGAATTCGAATACAT GTTGATANNNACGTATGCCA | 3158 | TGCAGGACCAGAGAATTCGAATACAT GTCTACCNNNACGTATGCCA | 3398 |
| TGCAGGACCAGAGAATTCGAATACAA TGCTCTCNNNACGTATGCCA | 2919 | TGCAGGACCAGAGAATTCGAATACAA GTATTACNNNACGTATGCCA | 3159 | TGCAGGACCAGAGAATTCGAATACAT GTAGTTANNNACGTATGCCA | 3399 |
| TGCAGGACCAGAGAATTCGAATACAT TATCTACNNNACGTATGCCA | 2920 | TGCAGGACCAGAGAATTCGAATACAG AGAACACNNNACGTATGCCA | 3160 | TGCAGGACCAGAGAATTCGAATACAT GGTTTANNNACGTATGCCA | 3400 |
| TGCAGGACCAGAGAATTCGAATACAT TCTATTGNNNACGTATGCCA | 2921 | TGCAGGACCAGAGAATTCGAATACAC CTAAATANNNACGTATGCCA | 3161 | TGCAGGACCAGAGAATTCGAATACAG AGACGGCNNNACGTATGCCA | 3401 |

FIG. 16B

| Pool-13 | SEQ ID NO: | Pool-14 | SEQ ID NO: | Pool-15 | SEQ ID NO: |
|---|---|---|---|---|---|
| TGCAGGACCAGAGAATTCGAATACAC CAGTACANNNACGTATGCCA | 2922 | TGCAGGACCAGAGAATTCGAATACAA TTTCACTNNNACGTATGCCA | 3162 | TGCAGGACCAGAGAATTCGAATACAC GTCGAGCNNNACGTATGCCA | 3402 |
| TGCAGGACCAGAGAATTCGAATACAA CAGAATANNNACGTATGCCA | 2923 | TGCAGGACCAGAGAATTCGAATACAG TCAACGTNNNACGTATGCCA | 3163 | TGCAGGACCAGAGAATTCGAATACAC AACAGTCNNNACGTATGCCA | 3403 |
| TGCAGGACCAGAGAATTCGAATACAG TATATACNNNACGTATGCCA | 2924 | TGCAGGACCAGAGAATTCGAATACAG CGTGCTGNNNACGTATGCCA | 3164 | TGCAGGACCAGAGAATTCGAATACAT GTTGCGANNNACGTATGCCA | 3404 |
| TGCAGGACCAGAGAATTCGAATACAT ATTAACGNNNACGTATGCCA | 2925 | TGCAGGACCAGAGAATTCGAATACAA AACCCACNNNACGTATGCCA | 3165 | TGCAGGACCAGAGAATTCGAATACAC GTATTTTNNNACGTATGCCA | 3405 |
| TGCAGGACCAGAGAATTCGAATACAG GTTAGAGNNNACGTATGCCA | 2926 | TGCAGGACCAGAGAATTCGAATACAC CCCTGTGNNNACGTATGCCA | 3166 | TGCAGGACCAGAGAATTCGAATACAG TACGTCANNNACGTATGCCA | 3406 |
| TGCAGGACCAGAGAATTCGAATACAC TAGGATCNNNACGTATGCCA | 2927 | TGCAGGACCAGAGAATTCGAATACAC GTAGCCTNNNACGTATGCCA | 3167 | TGCAGGACCAGAGAATTCGAATACAC CTAGCGGNNNACGTATGCCA | 3407 |
| TGCAGGACCAGAGAATTCGAATACAG ACTAGGANNNACGTATGCCA | 2928 | TGCAGGACCAGAGAATTCGAATACAA TCCATGGNNNACGTATGCCA | 3168 | TGCAGGACCAGAGAATTCGAATACAA GAGCCGGNNNACGTATGCCA | 3408 |
| TGCAGGACCAGAGAATTCGAATACAA CTTATCTNNNACGTATGCCA | 2929 | TGCAGGACCAGAGAATTCGAATACAC GCATCTTNNNACGTATGCCA | 3169 | TGCAGGACCAGAGAATTCGAATACAG GCGCCCGNNNACGTATGCCA | 3409 |
| TGCAGGACCAGAGAATTCGAATACAG ACGTCCGNNNACGTATGCCA | 2930 | TGCAGGACCAGAGAATTCGAATACAA GAATCCCNNNACGTATGCCA | 3170 | TGCAGGACCAGAGAATTCGAATACAC AGCATGTNNNACGTATGCCA | 3410 |
| TGCAGGACCAGAGAATTCGAATACAA TGGAAATNNNACGTATGCCA | 2931 | TGCAGGACCAGAGAATTCGAATACAC CTTGTGTNNNACGTATGCCA | 3171 | TGCAGGACCAGAGAATTCGAATACAA GCTTAATNNNACGTATGCCA | 3411 |
| TGCAGGACCAGAGAATTCGAATACAT GTTCAGGNNNACGTATGCCA | 2932 | TGCAGGACCAGAGAATTCGAATACAG AAACCAGNNNACGTATGCCA | 3172 | TGCAGGACCAGAGAATTCGAATACAC TCACCCGNNNACGTATGCCA | 3412 |
| TGCAGGACCAGAGAATTCGAATACAT GCAATCGNNNACGTATGCCA | 2933 | TGCAGGACCAGAGAATTCGAATACAG GATATCTNNNACGTATGCCA | 3173 | TGCAGGACCAGAGAATTCGAATACAT CGGAGCGNNNACGTATGCCA | 3413 |
| TGCAGGACCAGAGAATTCGAATACAT TATGGATNNNACGTATGCCA | 2934 | TGCAGGACCAGAGAATTCGAATACAA GGCCGAGNNNACGTATGCCA | 3174 | TGCAGGACCAGAGAATTCGAATACAC ACTGCCTNNNACGTATGCCA | 3414 |
| TGCAGGACCAGAGAATTCGAATACAA CATCGTGNNNACGTATGCCA | 2935 | TGCAGGACCAGAGAATTCGAATACAC ACTGTTCNNNACGTATGCCA | 3175 | TGCAGGACCAGAGAATTCGAATACAG CCTCCTGNNNACGTATGCCA | 3415 |
| TGCAGGACCAGAGAATTCGAATACAA AAGTAGTNNNACGTATGCCA | 2936 | TGCAGGACCAGAGAATTCGAATACAG TGGAGGCNNNACGTATGCCA | 3176 | TGCAGGACCAGAGAATTCGAATACAT AGTTAACNNNACGTATGCCA | 3416 |
| TGCAGGACCAGAGAATTCGAATACAT AATAACCNNNACGTATGCCA | 2937 | TGCAGGACCAGAGAATTCGAATACAA GTATCGCNNNACGTATGCCA | 3177 | TGCAGGACCAGAGAATTCGAATACAG GACTTCANNNACGTATGCCA | 3417 |
| TGCAGGACCAGAGAATTCGAATACAA TTCTCATNNNACGTATGCCA | 2938 | TGCAGGACCAGAGAATTCGAATACAT CGAGATCNNNACGTATGCCA | 3178 | TGCAGGACCAGAGAATTCGAATACAG CCGCATGNNNACGTATGCCA | 3418 |
| TGCAGGACCAGAGAATTCGAATACAA CATCCCTNNNACGTATGCCA | 2939 | TGCAGGACCAGAGAATTCGAATACAC GGTAGTTNNNACGTATGCCA | 3179 | TGCAGGACCAGAGAATTCGAATACAT GGAGTAGNNNACGTATGCCA | 3419 |
| TGCAGGACCAGAGAATTCGAATACAT GAAAGTANNNACGTATGCCA | 2940 | TGCAGGACCAGAGAATTCGAATACAC CGTATCTNNNACGTATGCCA | 3180 | TGCAGGACCAGAGAATTCGAATACAC TGTTATTNNNACGTATGCCA | 3420 |
| TGCAGGACCAGAGAATTCGAATACAG ACATTATNNNACGTATGCCA | 2941 | TGCAGGACCAGAGAATTCGAATACAA ACGCACTNNNACGTATGCCA | 3181 | TGCAGGACCAGAGAATTCGAATACAA AGAGCACNNNACGTATGCCA | 3421 |
| TGCAGGACCAGAGAATTCGAATACAG GATACGANNNACGTATGCCA | 2942 | TGCAGGACCAGAGAATTCGAATACAC CGATTGANNNACGTATGCCA | 3182 | TGCAGGACCAGAGAATTCGAATACAC GTCGAATNNNACGTATGCCA | 3422 |
| TGCAGGACCAGAGAATTCGAATACAG TACATATNNNACGTATGCCA | 2943 | TGCAGGACCAGAGAATTCGAATACAG CTCTAAGNNNACGTATGCCA | 3183 | TGCAGGACCAGAGAATTCGAATACAC TCGTGAANNNACGTATGCCA | 3423 |
| TGCAGGACCAGAGAATTCGAATACAT CATAGCGNNNACGTATGCCA | 2944 | TGCAGGACCAGAGAATTCGAATACAG GTGAGTANNNACGTATGCCA | 3184 | TGCAGGACCAGAGAATTCGAATACAG ATGGCAANNNACGTATGCCA | 3424 |
| TGCAGGACCAGAGAATTCGAATACAC TTGAACGNNNACGTATGCCA | 2945 | TGCAGGACCAGAGAATTCGAATACAG CCTATGANNNACGTATGCCA | 3185 | TGCAGGACCAGAGAATTCGAATACAT AGGTGGANNNACGTATGCCA | 3425 |
| TGCAGGACCAGAGAATTCGAATACAC TTCCCANNNNACGTATGCCA | 2946 | TGCAGGACCAGAGAATTCGAATACAA CGGAGCGNNNACGTATGCCA | 3186 | TGCAGGACCAGAGAATTCGAATACAG ATGACTCNNNACGTATGCCA | 3426 |
| TGCAGGACCAGAGAATTCGAATACAA GAGCCCCNNNACGTATGCCA | 2947 | TGCAGGACCAGAGAATTCGAATACAC TGTGACANNNACGTATGCCA | 3187 | TGCAGGACCAGAGAATTCGAATACAG CTCTGTTNNNACGTATGCCA | 3427 |
| TGCAGGACCAGAGAATTCGAATACAA TAATCACNNNACGTATGCCA | 2948 | TGCAGGACCAGAGAATTCGAATACAC GTCCGTCNNNACGTATGCCA | 3188 | TGCAGGACCAGAGAATTCGAATACAA CGCAACTNNNACGTATGCCA | 3428 |
| TGCAGGACCAGAGAATTCGAATACAG ACGACAANNNCTAGCGTTAC | 2949 | TGCAGGACCAGAGAATTCGAATACAA TCGTGACNNNCTAGCGTTAC | 3189 | TGCAGGACCAGAGAATTCGAATACAC GAATGCTNNNCTAGCGTTAC | 3429 |
| TGCAGGACCAGAGAATTCGAATACAC GAATTATNNNCTAGCGTTAC | 2950 | TGCAGGACCAGAGAATTCGAATACAC CATGTCTNNNCTAGCGTTAC | 3190 | TGCAGGACCAGAGAATTCGAATACAA GCCAATCNNNCTAGCGTTAC | 3430 |
| TGCAGGACCAGAGAATTCGAATACAC GCGCTGANNNCTAGCGTTAC | 2951 | TGCAGGACCAGAGAATTCGAATACAC CTTTTGGNNNCTAGCGTTAC | 3191 | TGCAGGACCAGAGAATTCGAATACAG CAGTTTGNNNCTAGCGTTAC | 3431 |
| TGCAGGACCAGAGAATTCGAATACAT CAATTAGNNNCTAGCGTTAC | 2952 | TGCAGGACCAGAGAATTCGAATACAC GCGTCGANNNCTAGCGTTAC | 3192 | TGCAGGACCAGAGAATTCGAATACAC GCAATGTNNNCTAGCGTTAC | 3432 |
| TGCAGGACCAGAGAATTCGAATACAA TGAGCAGNNNCTAGCGTTAC | 2953 | TGCAGGACCAGAGAATTCGAATACAG CCCCCATNNNCTAGCGTTAC | 3193 | TGCAGGACCAGAGAATTCGAATACAT GCAGTGTNNNCTAGCGTTAC | 3433 |
| TGCAGGACCAGAGAATTCGAATACAT GACTTAANNNCTAGCGTTAC | 2954 | TGCAGGACCAGAGAATTCGAATACAG TCTTTCGNNNCTAGCGTTAC | 3194 | TGCAGGACCAGAGAATTCGAATACAA GTCCATGNNNCTAGCGTTAC | 3434 |

FIG. 16C

| Pool-13 | SEQ ID NO: | Pool-14 | SEQ ID NO: | Pool-15 | SEQ ID NO: |
|---|---|---|---|---|---|
| TGCAGGACCAGAGAATTCGAATACATGAGAATANNNCTAGCGTTAC | 2955 | TGCAGGACCAGAGAATTCGAATACAAPCCACGANNNCTAGCGTTAC | 3195 | TGCAGGACCAGAGAATTCGAATACACTATTCATNNNCTAGCGTTAC | 3435 |
| TGCAGGACCAGAGAATTCGAATACACTTTTTCTNNNCTAGCGTTAC | 2956 | TGCAGGACCAGAGAATTCGAATACATATGCATANNNCTAGCGTTAC | 3196 | TGCAGGACCAGAGAATTCGAATACAGTCGTTCTNNNCTAGCGTTAC | 3436 |
| TGCAGGACCAGAGAATTCGAATACAGTCGCAATNNNCTAGCGTTAC | 2957 | TGCAGGACCAGAGAATTCGAATACAGAGAAATTNNNCTAGCGTTAC | 3197 | TGCAGGACCAGAGAATTCGAATACACGTTGTAGNNNCTAGCGTTAC | 3437 |
| TGCAGGACCAGAGAATTCGAATACAATCCATCCNNNCTAGCGTTAC | 2958 | TGCAGGACCAGAGAATTCGAATACACCTCAATCNNNCTAGCGTTAC | 3198 | TGCAGGACCAGAGAATTCGAATACAGACAGCGGNNNCTAGCGTTAC | 3438 |
| TGCAGGACCAGAGAATTCGAATACAAGATATGANNNCTAGCGTTAC | 2959 | TGCAGGACCAGAGAATTCGAATACACAAAACAANNNCTAGCGTTAC | 3199 | TGCAGGACCAGAGAATTCGAATACATACACCCTNNNCTAGCGTTAC | 3439 |
| TGCAGGACCAGAGAATTCGAATACATAGCTACGNNNCTAGCGTTAC | 2960 | TGCAGGACCAGAGAATTCGAATACAGTGATGTCNNNCTAGCGTTAC | 3200 | TGCAGGACCAGAGAATTCGAATACACGTTAAGCNNNCTAGCGTTAC | 3440 |
| TGCAGGACCAGAGAATTCGAATACATTACAGGCNNNCTAGCGTTAC | 2961 | TGCAGGACCAGAGAATTCGAATACATGCCGTAANNNCTAGCGTTAC | 3201 | TGCAGGACCAGAGAATTCGAATACAATCGCCTTNNNCTAGCGTTAC | 3441 |
| TGCAGGACCAGAGAATTCGAATACATACTACACNNNCTAGCGTTAC | 2962 | TGCAGGACCAGAGAATTCGAATACAGGCTCTAGNNNCTAGCGTTAC | 3202 | TGCAGGACCAGAGAATTCGAATACAGCTATGCANNNCTAGCGTTAC | 3442 |
| TGCAGGACCAGAGAATTCGAATACAATTTTAGGNNNCTAGCGTTAC | 2963 | TGCAGGACCAGAGAATTCGAATACAGGCGTGCTNNNCTAGCGTTAC | 3203 | TGCAGGACCAGAGAATTCGAATACAACGCACGCNNNCTAGCGTTAC | 3443 |
| TGCAGGACCAGAGAATTCGAATACATTTTCAGTNNNCTAGCGTTAC | 2964 | TGCAGGACCAGAGAATTCGAATACAGACGTCATNNNCTAGCGTTAC | 3204 | TGCAGGACCAGAGAATTCGAATACACGTCACAANNNCTAGCGTTAC | 3444 |
| TGCAGGACCAGAGAATTCGAATACAGCAGAACANNNCTAGCGTTAC | 2965 | TGCAGGACCAGAGAATTCGAATACATGTATTAGNNNCTAGCGTTAC | 3205 | TGCAGGACCAGAGAATTCGAATACACGCGATCGNNNCTAGCGTTAC | 3445 |
| TGCAGGACCAGAGAATTCGAATACACGAGTAGANNNCTAGCGTTAC | 2966 | TGCAGGACCAGAGAATTCGAATACAATGATTACNNNCTAGCGTTAC | 3206 | TGCAGGACCAGAGAATTCGAATACAGTTAGACCNNNCTAGCGTTAC | 3446 |
| TGCAGGACCAGAGAATTCGAATACAGTCGGAGNNNCTAGCGTTAC | 2967 | TGCAGGACCAGAGAATTCGAATACAACTCCGAANNNCTAGCGTTAC | 3207 | TGCAGGACCAGAGAATTCGAATACATCGCGAGCNNNCTAGCGTTAC | 3447 |
| TGCAGGACCAGAGAATTCGAATACAATGTACTANNNCTAGCGTTAC | 2968 | TGCAGGACCAGAGAATTCGAATACATTCTTCCCNNNCTAGCGTTAC | 3208 | TGCAGGACCAGAGAATTCGAATACATGTAAACTNNNCTAGCGTTAC | 3448 |
| TGCAGGACCAGAGAATTCGAATACATACTCCGTNNNCTAGCGTTAC | 2969 | TGCAGGACCAGAGAATTCGAATACATCTCCTAGNNNCTAGCGTTAC | 3209 | TGCAGGACCAGAGAATTCGAATACATGCCATAGNNNCTAGCGTTAC | 3449 |
| TGCAGGACCAGAGAATTCGAATACACBCATTGNNNNCTAGCGTTAC | 2970 | TGCAGGACCAGAGAATTCGAATACAGACTTATANNNCTAGCGTTAC | 3210 | TGCAGGACCAGAGAATTCGAATACATAATTACGNNNCTAGCGTTAC | 3450 |
| TGCAGGACCAGAGAATTCGAATACATTAGCAATNNNCTAGCGTTAC | 2971 | TGCAGGACCAGAGAATTCGAATACACGAGTGAANNNCTAGCGTTAC | 3211 | TGCAGGACCAGAGAATTCGAATACACCCCGCCNNNNCTAGCGTTAC | 3451 |
| TGCAGGACCAGAGAATTCGAATACATCCAACGANNNCTAGCGTTAC | 2972 | TGCAGGACCAGAGAATTCGAATACATATAAATTNNNCTAGCGTTAC | 3212 | TGCAGGACCAGAGAATTCGAATACACAATATCANNNCTAGCGTTAC | 3452 |
| TGCAGGACCAGAGAATTCGAATACATTGATCCCNNNCTAGCGTTAC | 2973 | TGCAGGACCAGAGAATTCGAATACAGCCGTGAGNNNCTAGCGTTAC | 3213 | TGCAGGACCAGAGAATTCGAATACAATTAAGGANNNCTAGCGTTAC | 3453 |
| TGCAGGACCAGAGAATTCGAATACATATTAATANNNCTAGCGTTAC | 2974 | TGCAGGACCAGAGAATTCGAATACAAGTCCCTTNNNCTAGCGTTAC | 3214 | TGCAGGACCAGAGAATTCGAATACAATATACACNNNCTAGCGTTAC | 3454 |
| TGCAGGACCAGAGAATTCGAATACATAAGTTTGNNNCTAGCGTTAC | 2975 | TGCAGGACCAGAGAATTCGAATACAAGACTTANNNNCTAGCGTTAC | 3215 | TGCAGGACCAGAGAATTCGAATACATATTGACANNNCTAGCGTTAC | 3455 |
| TGCAGGACCAGAGAATTCGAATACAGGCCGCGCNNNCTAGCGTTAC | 2976 | TGCAGGACCAGAGAATTCGAATACATGGCACTANNNCTAGCGTTAC | 3216 | TGCAGGACCAGAGAATTCGAATACAACGAAAATNNNCTAGCGTTAC | 3456 |
| TGCAGGACCAGAGAATTCGAATACATCACACGANNNCTAGCGTTAC | 2977 | TGCAGGACCAGAGAATTCGAATACAATTCCTATNNNCTAGCGTTAC | 3217 | TGCAGGACCAGAGAATTCGAATACAGTAGGACANNNCTAGCGTTAC | 3457 |
| TGCAGGACCAGAGAATTCGAATACAGAGTCGTTNNNCTAGCGTTAC | 2978 | TGCAGGACCAGAGAATTCGAATACATGATATANNNNCTAGCGTTAC | 3218 | TGCAGGACCAGAGAATTCGAATACACCCCAGTNNNNCTAGCGTTAC | 3458 |
| TGCAGGACCAGAGAATTCGAATACAAGAGCCTTNNNCTAGCGTTAC | 2979 | TGCAGGACCAGAGAATTCGAATACACAAGCACTNNNCTAGCGTTAC | 3219 | TGCAGGACCAGAGAATTCGAATACACCTACGTTNNNCTAGCGTTAC | 3459 |
| TGCAGGACCAGAGAATTCGAATACACCTTGCTANNNCTAGCGTTAC | 2980 | TGCAGGACCAGAGAATTCGAATACAGCGCATGCNNNCTAGCGTTAC | 3220 | TGCAGGACCAGAGAATTCGAATACATGGTGAGANNNCTAGCGTTAC | 3460 |
| TGCAGGACCAGAGAATTCGAATACAATCATAGTNNNCTAGCGTTAC | 2981 | TGCAGGACCAGAGAATTCGAATACATCCTCAATNNNCTAGCGTTAC | 3221 | TGCAGGACCAGAGAATTCGAATACATTAGCACANNNCTAGCGTTAC | 3461 |
| TGCAGGACCAGAGAATTCGAATACATAGCAATNNNNCTAGCGTTAC | 2982 | TGCAGGACCAGAGAATTCGAATACATCGCACCNNNNCTAGCGTTAC | 3222 | TGCAGGACCAGAGAATTCGAATACATCATGTAANNNCTAGCGTTAC | 3462 |
| TGCAGGACCAGAGAATTCGAATACACAATTGTANNNCTAGCGTTAC | 2983 | TGCAGGACCAGAGAATTCGAATACATGACGGACNNNCTAGCGTTAC | 3223 | TGCAGGACCAGAGAATTCGAATACAGGACGAATNNNCTAGCGTTAC | 3463 |
| TGCAGGACCAGAGAATTCGAATACATTCGGCAANNNCTAGCGTTAC | 2984 | TGCAGGACCAGAGAATTCGAATACACGAACAGANNNCTAGCGTTAC | 3224 | TGCAGGACCAGAGAATTCGAATACAGGATGGCGNNNCTAGCGTTAC | 3464 |
| TGCAGGACCAGAGAATTCGAATACACCTAGTCTNNNCTAGCGTTAC | 2985 | TGCAGGACCAGAGAATTCGAATACATATCTCGCNNNCTAGCGTTAC | 3225 | TGCAGGACCAGAGAATTCGAATACATCCCAGTTNNNCTAGCGTTAC | 3465 |
| TGCAGGACCAGAGAATTCGAATACACTAGGCTANNNCTAGCGTTAC | 2986 | TGCAGGACCAGAGAATTCGAATACATGCATCAGNNNCTAGCGTTAC | 3226 | TGCAGGACCAGAGAATTCGAATACACGAGACAANNNCTAGCGTTAC | 3466 |
| TGCAGGACCAGAGAATTCGAATACAAATCAATCNNNCTAGCGTTAC | 2987 | TGCAGGACCAGAGAATTCGAATACACCTAAAGCNNNCTAGCGTTAC | 3227 | TGCAGGACCAGAGAATTCGAATACACAATACCGNNNCTAGCGTTAC | 3467 |

FIG. 16D

| Pool-13 | SEQ ID NO: | Pool-14 | SEQ ID NO: | Pool-15 | SEQ ID NO: |
|---|---|---|---|---|---|
| TGCAGGACCAGAGAATTCGAATACAGCCCTCGTNNNCTAGCGTTAC | 2988 | TGCAGGACCAGAGAATTCGAATACATTTGACAANNNCTAGCGTTAC | 3228 | TGCAGGACCAGAGAATTCGAATACATTTATGTCNNNCTAGCGTTAC | 3468 |
| TGCAGGACCAGAGAATTCGAATACAAGGTTGAGNNNCTAGCGTTAC | 2989 | TGCAGGACCAGAGAATTCGAATACACCCGCCATNNNCTAGCGTTAC | 3229 | TGCAGGACCAGAGAATTCGAATACATGGTAACCNNNCTAGCGTTAC | 3469 |
| TGCAGGACCAGAGAATTCGAATACACAGCCAGCNNNCTAGCGTTAC | 2990 | TGCAGGACCAGAGAATTCGAATACATTGCATAANNNCTAGCGTTAC | 3230 | TGCAGGACCAGAGAATTCGAATACAAGCCCATANNNCTAGCGTTAC | 3470 |
| TGCAGGACCAGAGAATTCGAATACAACTAATGTNNNCTAGCGTTAC | 2991 | TGCAGGACCAGAGAATTCGAATACAACAGAGCANNNCTAGCGTTAC | 3231 | TGCAGGACCAGAGAATTCGAATACAATCCTCCANNNCTAGCGTTAC | 3471 |
| TGCAGGACCAGAGAATTCGAATACAGGTAAGACNNNCTAGCGTTAC | 2992 | TGCAGGACCAGAGAATTCGAATACAGGTACGTTNNNCTAGCGTTAC | 3232 | TGCAGGACCAGAGAATTCGAATACATTTTTGACNNNCTAGCGTTAC | 3472 |
| TGCAGGACCAGAGAATTCGAATACACTCGCGAGNNNCTAGCGTTAC | 2993 | TGCAGGACCAGAGAATTCGAATACAATGCACTNNNCTAGCGTTAC | 3233 | TGCAGGACCAGAGAATTCGAATACAATAGCCTGNNNCTAGCGTTAC | 3473 |
| TGCAGGACCAGAGAATTCGAATACACTGCCGCTNNNCTAGCGTTAC | 2994 | TGCAGGACCAGAGAATTCGAATACAATCTAAACNNNCTAGCGTTAC | 3234 | TGCAGGACCAGAGAATTCGAATACAGGAGTCTNNNCTAGCGTTAC | 3474 |
| TGCAGGACCAGAGAATTCGAATACAACTGCGGCNNNCTAGCGTTAC | 2995 | TGCAGGACCAGAGAATTCGAATACAACGAGAACNNNCTAGCGTTAC | 3235 | TGCAGGACCAGAGAATTCGAATACAACCCCACCNNNCTAGCGTTAC | 3475 |
| TGCAGGACCAGAGAATTCGAATACACCTCTACANNNCTAGCGTTAC | 2996 | TGCAGGACCAGAGAATTCGAATACACCGCAAGCNNNCTAGCGTTAC | 3236 | TGCAGGACCAGAGAATTCGAATACACGCGGCATNNNCTAGCGTTAC | 3476 |
| TGCAGGACCAGAGAATTCGAATACATGGCCACGNNNCTAGCGTTAC | 2997 | TGCAGGACCAGAGAATTCGAATACAACGACAAGNNNCTAGCGTTAC | 3237 | TGCAGGACCAGAGAATTCGAATACATCCAGACANNNCTAGCGTTAC | 3477 |
| TGCAGGACCAGAGAATTCGAATACAACGCAATCNNNCTAGCGTTAC | 2998 | TGCAGGACCAGAGAATTCGAATACACGCCGATGNNNCTAGCGTTAC | 3238 | TGCAGGACCAGAGAATTCGAATACAAAATGCAANNNCTAGCGTTAC | 3478 |
| TGCAGGACCAGAGAATTCGAATACAGGTTTGCANNNCTAGCGTTAC | 2999 | TGCAGGACCAGAGAATTCGAATACAAATCGACGNNNCTAGCGTTAC | 3239 | TGCAGGACCAGAGAATTCGAATACAAATTCGCGNNNCTAGCGTTAC | 3479 |
| TGCAGGACCAGAGAATTCGAATACAGGTTAGGANNNCTAGCGTTAC | 3000 | TGCAGGACCAGAGAATTCGAATACAATTAATGCNNNCTAGCGTTAC | 3240 | TGCAGGACCAGAGAATTCGAATACAGTGTCCTTNNNCTAGCGTTAC | 3480 |
| TGCAGGACCAGAGAATTCGAATACATCCTCGGCNNNCTAGCGTTAC | 3001 | TGCAGGACCAGAGAATTCGAATACAGCGCTTCNNNCTAGCGTTAC | 3241 | TGCAGGACCAGAGAATTCGAATACACATGTAATNNNCTAGCGTTAC | 3481 |
| TGCAGGACCAGAGAATTCGAATACAAACACGGNNNCTAGCGTTAC | 3002 | TGCAGGACCAGAGAATTCGAATACATACAATTGNNNCTAGCGTTAC | 3242 | TGCAGGACCAGAGAATTCGAATACAACGCATACNNNCTAGCGTTAC | 3482 |
| TGCAGGACCAGAGAATTCGAATACAGAAAATCANNNCTAGCGTTAC | 3003 | TGCAGGACCAGAGAATTCGAATACAGTGGAACANNNCTAGCGTTAC | 3243 | TGCAGGACCAGAGAATTCGAATACAAGCCCCCNNNCTAGCGTTAC | 3483 |
| TGCAGGACCAGAGAATTCGAATACACGTATCTCNNNCTAGCGTTAC | 3004 | TGCAGGACCAGAGAATTCGAATACACTCTGTGTNNNCTAGCGTTAC | 3244 | TGCAGGACCAGAGAATTCGAATACACTCCCCAGNNNCTAGCGTTAC | 3484 |
| TGCAGGACCAGAGAATTCGAATACACGGCCACANNNCTAGCGTTAC | 3005 | TGCAGGACCAGAGAATTCGAATACATGCAGTACNNNCTAGCGTTAC | 3245 | TGCAGGACCAGAGAATTCGAATACATCTACTTANNNCTAGCGTTAC | 3485 |
| TGCAGGACCAGAGAATTCGAATACATCATTCATNNNCTAGCGTTAC | 3006 | TGCAGGACCAGAGAATTCGAATACAGACAACTCNNNCTAGCGTTAC | 3246 | TGCAGGACCAGAGAATTCGAATACATACCGGTANNNCTAGCGTTAC | 3486 |
| TGCAGGACCAGAGAATTCGAATACAATAGATGANNNCTAGCGTTAC | 3007 | TGCAGGACCAGAGAATTCGAATACACGAGAGGCNNNCTAGCGTTAC | 3247 | TGCAGGACCAGAGAATTCGAATACAAACCTATANNNCTAGCGTTAC | 3487 |
| TGCAGGACCAGAGAATTCGAATACAGCACTGCGNNNCTAGCGTTAC | 3008 | TGCAGGACCAGAGAATTCGAATACACTAAATGTNNNCTAGCGTTAC | 3248 | TGCAGGACCAGAGAATTCGAATACAGCGACTGCNNNCTAGCGTTAC | 3488 |
| TGCAGGACCAGAGAATTCGAATACACCTCCCTANNNGATCGACATG | 3009 | TGCAGGACCAGAGAATTCGAATACAGGCTCACGNNNGATCGACATG | 3249 | TGCAGGACCAGAGAATTCGAATACACGAGTCTANNNGATCGACATG | 3489 |
| TGCAGGACCAGAGAATTCGAATACAACAAAACANNNGATCGACATG | 3010 | TGCAGGACCAGAGAATTCGAATACAACGTTTCCNNNGATCGACATG | 3250 | TGCAGGACCAGAGAATTCGAATACATATGAAAGNNNGATCGACATG | 3490 |
| TGCAGGACCAGAGAATTCGAATACATATGTACANNNGATCGACATG | 3011 | TGCAGGACCAGAGAATTCGAATACATGCCAGTANNNGATCGACATG | 3251 | TGCAGGACCAGAGAATTCGAATACAACTGGCCGNNNGATCGACATG | 3491 |
| TGCAGGACCAGAGAATTCGAATACATCGGTCTTNNNGATCGACATG | 3012 | TGCAGGACCAGAGAATTCGAATACAGTAAGTGGNNNGATCGACATG | 3252 | TGCAGGACCAGAGAATTCGAATACACAACCATGNNNGATCGACATG | 3492 |
| TGCAGGACCAGAGAATTCGAATACATCCATATTNNNGATCGACATG | 3013 | TGCAGGACCAGAGAATTCGAATACACACCTACTNNNGATCGACATG | 3253 | TGCAGGACCAGAGAATTCGAATACAAAGGTAGCNNNGATCGACATG | 3493 |
| TGCAGGACCAGAGAATTCGAATACAATGACTCGNNNGATCGACATG | 3014 | TGCAGGACCAGAGAATTCGAATACAGATTTGATNNNGATCGACATG | 3254 | TGCAGGACCAGAGAATTCGAATACATTCTCAGCNNNGATCGACATG | 3494 |
| TGCAGGACCAGAGAATTCGAATACATAATCTCTNNNGATCGACATG | 3015 | TGCAGGACCAGAGAATTCGAATACAACTACATNNNGATCGACATG | 3255 | TGCAGGACCAGAGAATTCGAATACATTCAGGTGNNNGATCGACATG | 3495 |
| TGCAGGACCAGAGAATTCGAATACAGAATACTTNNNGATCGACATG | 3016 | TGCAGGACCAGAGAATTCGAATACAGCCTTGAANNNGATCGACATG | 3256 | TGCAGGACCAGAGAATTCGAATACACCAATCCTNNNGATCGACATG | 3496 |
| TGCAGGACCAGAGAATTCGAATACACCACTAGANNNGATCGACATG | 3017 | TGCAGGACCAGAGAATTCGAATACATAATATTANNNGATCGACATG | 3257 | TGCAGGACCAGAGAATTCGAATACAGACAGTTCNNNGATCGACATG | 3497 |
| TGCAGGACCAGAGAATTCGAATACATTTGGACCNNNGATCGACATG | 3018 | TGCAGGACCAGAGAATTCGAATACAGGTTTAATNNNGATCGACATG | 3258 | TGCAGGACCAGAGAATTCGAATACAATCTTTACNNNGATCGACATG | 3498 |
| TGCAGGACCAGAGAATTCGAATACAGAAGTCCTNNNGATCGACATG | 3019 | TGCAGGACCAGAGAATTCGAATACACCCACCGTNNNGATCGACATG | 3259 | TGCAGGACCAGAGAATTCGAATACAGCAATATTNNNGATCGACATG | 3499 |
| TGCAGGACCAGAGAATTCGAATACACCTATGCTNNNGATCGACATG | 3020 | TGCAGGACCAGAGAATTCGAATACACTACTTCGNNNGATCGACATG | 3260 | TGCAGGACCAGAGAATTCGAATACAGTCTCCATNNNGATCGACATG | 3500 |

FIG. 16E

| Pool-13 | SEQ ID NO: | Pool-14 | SEQ ID NO: | Pool-15 | SEQ ID NO: |
|---|---|---|---|---|---|
| TGCAGGACCAGAGAATTCGAATACATCGATGTGNNNGATCGACATG | 3021 | TGCAGGACCAGAGAATTCGAATACAATGCGTCANNNGATCGACATG | 3261 | TGCAGGACCAGAGAATTCGAATACACAACAATTNNNGATCGACATG | 3501 |
| TGCAGGACCAGAGAATTCGAATACATGTACACGNNNGATCGACATG | 3022 | TGCAGGACCAGAGAATTCGAATACAAACATGTTNNNGATCGACATG | 3262 | TGCAGGACCAGAGAATTCGAATACATCGTAGACNNNGATCGACATG | 3502 |
| TGCAGGACCAGAGAATTCGAATACATCTTTAGTNNNGATCGACATG | 3023 | TGCAGGACCAGAGAATTCGAATACACCTGTTTGNNNGATCGACATG | 3263 | TGCAGGACCAGAGAATTCGAATACAGTAGATAANNNGATCGACATG | 3503 |
| TGCAGGACCAGAGAATTCGAATACACGTAGGCCNNNGATCGACATG | 3024 | TGCAGGACCAGAGAATTCGAATACAAACAAGCTNNNGATCGACATG | 3264 | TGCAGGACCAGAGAATTCGAATACAACATATACNNNGATCGACATG | 3504 |
| TGCAGGACCAGAGAATTCGAATACAACCTTTATNNNGATCGACATG | 3025 | TGCAGGACCAGAGAATTCGAATACAGATAAGATNNNGATCGACATG | 3265 | TGCAGGACCAGAGAATTCGAATACACACGACGCNNNGATCGACATG | 3505 |
| TGCAGGACCAGAGAATTCGAATACACGTCTATCNNNGATCGACATG | 3026 | TGCAGGACCAGAGAATTCGAATACACGACCTCANNNGATCGACATG | 3266 | TGCAGGACCAGAGAATTCGAATACACACAAAAANNNGATCGACATG | 3506 |
| TGCAGGACCAGAGAATTCGAATACAGTAGAAATNNNGATCGACATG | 3027 | TGCAGGACCAGAGAATTCGAATACACTCCAAGANNNGATCGACATG | 3267 | TGCAGGACCAGAGAATTCGAATACACGTACCGGNNNGATCGACATG | 3507 |
| TGCAGGACCAGAGAATTCGAATACACGTACCAANNNGATCGACATG | 3028 | TGCAGGACCAGAGAATTCGAATACAGGTATTCGNNNGATCGACATG | 3268 | TGCAGGACCAGAGAATTCGAATACACCACAATGNNNGATCGACATG | 3508 |
| TGCAGGACCAGAGAATTCGAATACACACCACCCNNNGATCGACATG | 3029 | TGCAGGACCAGAGAATTCGAATACAACTCGGATNNNGATCGACATG | 3269 | TGCAGGACCAGAGAATTCGAATACACGCTCTGCNNNGATCGACATG | 3509 |
| TGCAGGACCAGAGAATTCGAATACATGCGGCGTNNNGATCGACATG | 3030 | TGCAGGACCAGAGAATTCGAATACATATATGGANNNGATCGACATG | 3270 | TGCAGGACCAGAGAATTCGAATACAGTCAAGCTNNNGATCGACATG | 3510 |
| TGCAGGACCAGAGAATTCGAATACAGCCCCCCGNNNGATCGACATG | 3031 | TGCAGGACCAGAGAATTCGAATACAATCCACTCNNNGATCGACATG | 3271 | TGCAGGACCAGAGAATTCGAATACAACTCTTCGNNNGATCGACATG | 3511 |
| TGCAGGACCAGAGAATTCGAATACATAGTAAGANNNGATCGACATG | 3032 | TGCAGGACCAGAGAATTCGAATACAGAACTGGANNNGATCGACATG | 3272 | TGCAGGACCAGAGAATTCGAATACAAACACGANNNGATCGACATG | 3512 |
| TGCAGGACCAGAGAATTCGAATACATCTGAATANNNGATCGACATG | 3033 | TGCAGGACCAGAGAATTCGAATACAGATCAGAGNNNGATCGACATG | 3273 | TGCAGGACCAGAGAATTCGAATACAACCGCGCANNNGATCGACATG | 3513 |
| TGCAGGACCAGAGAATTCGAATACACTAATACANNNGATCGACATG | 3034 | TGCAGGACCAGAGAATTCGAATACATTGAACTANNNGATCGACATG | 3274 | TGCAGGACCAGAGAATTCGAATACACACCTTGTNNNGATCGACATG | 3514 |
| TGCAGGACCAGAGAATTCGAATACAATGTCACGNNNGATCGACATG | 3035 | TGCAGGACCAGAGAATTCGAATACAGCCAGCANNNGATCGACATG | 3275 | TGCAGGACCAGAGAATTCGAATACATTATGCGGNNNGATCGACATG | 3515 |
| TGCAGGACCAGAGAATTCGAATACAAACAGAATNNNGATCGACATG | 3036 | TGCAGGACCAGAGAATTCGAATACATTTACTGTNNNGATCGACATG | 3276 | TGCAGGACCAGAGAATTCGAATACAGACTCTTCNNNGATCGACATG | 3516 |
| TGCAGGACCAGAGAATTCGAATACAGCCCAGGTNNNGATCGACATG | 3037 | TGCAGGACCAGAGAATTCGAATACATGTCAGGTNNNGATCGACATG | 3277 | TGCAGGACCAGAGAATTCGAATACAGAGTCTTGNNNGATCGACATG | 3517 |
| TGCAGGACCAGAGAATTCGAATACAGCTCATGANNNGATCGACATG | 3038 | TGCAGGACCAGAGAATTCGAATACACAGCGTTANNNGATCGACATG | 3278 | TGCAGGACCAGAGAATTCGAATACATAGAATCTNNNGATCGACATG | 3518 |
| TGCAGGACCAGAGAATTCGAATACACCCGTCGANNNGATCGACATG | 3039 | TGCAGGACCAGAGAATTCGAATACATGTGATCGNNNGATCGACATG | 3279 | TGCAGGACCAGAGAATTCGAATACACGACCAGCNNNGATCGACATG | 3519 |
| TGCAGGACCAGAGAATTCGAATACACAATTCCNNNGATCGACATG | 3040 | TGCAGGACCAGAGAATTCGAATACAGCTCGTAANNNGATCGACATG | 3280 | TGCAGGACCAGAGAATTCGAATACATGGATTCGNNNGATCGACATG | 3520 |
| TGCAGGACCAGAGAATTCGAATACACCAGGCCANNNGATCGACATG | 3041 | TGCAGGACCAGAGAATTCGAATACAATTCTACTNNNGATCGACATG | 3281 | TGCAGGACCAGAGAATTCGAATACACGACTAGTNNNGATCGACATG | 3521 |
| TGCAGGACCAGAGAATTCGAATACACCTGCGGANNNGATCGACATG | 3042 | TGCAGGACCAGAGAATTCGAATACAGATCAGTCNNNGATCGACATG | 3282 | TGCAGGACCAGAGAATTCGAATACACCCAAAACNNNGATCGACATG | 3522 |
| TGCAGGACCAGAGAATTCGAATACAGCTAAAGGNNNGATCGACATG | 3043 | TGCAGGACCAGAGAATTCGAATACAGGATTATTNNNGATCGACATG | 3283 | TGCAGGACCAGAGAATTCGAATACATGACCCCCNNNGATCGACATG | 3523 |
| TGCAGGACCAGAGAATTCGAATACATTTAAGGTNNNGATCGACATG | 3044 | TGCAGGACCAGAGAATTCGAATACACCATTCGTNNNGATCGACATG | 3284 | TGCAGGACCAGAGAATTCGAATACAGCATTAGCNNNGATCGACATG | 3524 |
| TGCAGGACCAGAGAATTCGAATACAAACGTAANNNGATCGACATG | 3045 | TGCAGGACCAGAGAATTCGAATACAGTACATGCNNNGATCGACATG | 3285 | TGCAGGACCAGAGAATTCGAATACAGCCAGATTNNNGATCGACATG | 3525 |
| TGCAGGACCAGAGAATTCGAATACAAATTTGGTNNNGATCGACATG | 3046 | TGCAGGACCAGAGAATTCGAATACACGTCCAGNNNGATCGACATG | 3286 | TGCAGGACCAGAGAATTCGAATACAACAACTATNNNGATCGACATG | 3526 |
| TGCAGGACCAGAGAATTCGAATACAACGTTAGCNNNGATCGACATG | 3047 | TGCAGGACCAGAGAATTCGAATACATATTTGTCNNNGATCGACATG | 3287 | TGCAGGACCAGAGAATTCGAATACAGTAGGTCNNNGATCGACATG | 3527 |
| TGCAGGACCAGAGAATTCGAATACAAGTTTTGNNNGATCGACATG | 3048 | TGCAGGACCAGAGAATTCGAATACAACAGTCCANNNGATCGACATG | 3288 | TGCAGGACCAGAGAATTCGAATACAAATAAGGTNNNGATCGACATG | 3528 |
| TGCAGGACCAGAGAATTCGAATACAAGCGTTCANNNGATCGACATG | 3049 | TGCAGGACCAGAGAATTCGAATACAGCGATTGTNNNGATCGACATG | 3289 | TGCAGGACCAGAGAATTCGAATACAAAGAGAAANNNGATCGACATG | 3529 |
| TGCAGGACCAGAGAATTCGAATACAGGACTTGTNNNGATCGACATG | 3050 | TGCAGGACCAGAGAATTCGAATACACCTGGAATNNNGATCGACATG | 3290 | TGCAGGACCAGAGAATTCGAATACATTTTGTGTNNNGATCGACATG | 3530 |
| TGCAGGACCAGAGAATTCGAATACACGTCAGATNNNGATCGACATG | 3051 | TGCAGGACCAGAGAATTCGAATACAAGGAGCAANNNGATCGACATG | 3291 | TGCAGGACCAGAGAATTCGAATACAAGGCGTTTNNNGATCGACATG | 3531 |
| TGCAGGACCAGAGAATTCGAATACACCAGAAGANNNGATCGACATG | 3052 | TGCAGGACCAGAGAATTCGAATACAACACCAACNNNGATCGACATG | 3292 | TGCAGGACCAGAGAATTCGAATACAAAAAGCTANNNGATCGACATG | 3532 |
| TGCAGGACCAGAGAATTCGAATACAGCGATCTANNNGATCGACATG | 3053 | TGCAGGACCAGAGAATTCGAATACATTTAGTCTNNNGATCGACATG | 3293 | TGCAGGACCAGAGAATTCGAATACAACCGGATTNNNGATCGACATG | 3533 |

FIG. 16F

| Pool-13 | SEQ ID NO: | Pool-14 | SEQ ID NO: | Pool-15 | SEQ ID NO: |
|---|---|---|---|---|---|
| TGCAGGACCAGAGAATTCGAATACAATCACCGANNNGATCGACATG | 3054 | TGCAGGACCAGAGAATTCGAATACATGTAGCTGNNNGATCGACATG | 3294 | TGCAGGACCAGAGAATTCGAATACACTCAAATANNNGATCGACATG | 3534 |
| TGCAGGACCAGAGAATTCGAATACAACACTAATNNNGATCGACATG | 3055 | TGCAGGACCAGAGAATTCGAATACAGGCTTACANNNGATCGACATG | 3295 | TGCAGGACCAGAGAATTCGAATACACGAGAACANNNGATCGACATG | 3535 |
| TGCAGGACCAGAGAATTCGAATACAATATGAAGNNNGATCGACATG | 3056 | TGCAGGACCAGAGAATTCGAATACAGGACCAGCNNNGATCGACATG | 3296 | TGCAGGACCAGAGAATTCGAATACACCCAGGACNNNGATCGACATG | 3536 |
| TGCAGGACCAGAGAATTCGAATACAAGTAAGCGNNNGATCGACATG | 3057 | TGCAGGACCAGAGAATTCGAATACACCCAAAAGNNNGATCGACATG | 3297 | TGCAGGACCAGAGAATTCGAATACACCAGCTCCNNNGATCGACATG | 3537 |
| TGCAGGACCAGAGAATTCGAATACAGACGCTATNNNGATCGACATG | 3058 | TGCAGGACCAGAGAATTCGAATACACGAGGTANNNGATCGACATG | 3298 | TGCAGGACCAGAGAATTCGAATACATATACATGNNNGATCGACATG | 3538 |
| TGCAGGACCAGAGAATTCGAATACATGACATCGNNNGATCGACATG | 3059 | TGCAGGACCAGAGAATTCGAATACACAGTCATGNNNGATCGACATG | 3299 | TGCAGGACCAGAGAATTCGAATACATATAGTTGNNNGATCGACATG | 3539 |
| TGCAGGACCAGAGAATTCGAATACAGCAGAAACNNNGATCGACATG | 3060 | TGCAGGACCAGAGAATTCGAATACATGACCACANNNGATCGACATG | 3300 | TGCAGGACCAGAGAATTCGAATACACATAGTTANNNGATCGACATG | 3540 |
| TGCAGGACCAGAGAATTCGAATACATTTTGCANNNGATCGACATG | 3061 | TGCAGGACCAGAGAATTCGAATACATGAACACANNNGATCGACATG | 3301 | TGCAGGACCAGAGAATTCGAATACATTCATTACNNNGATCGACATG | 3541 |
| TGCAGGACCAGAGAATTCGAATACACTACCCGCNNNGATCGACATG | 3062 | TGCAGGACCAGAGAATTCGAATACATAGTAATCNNNGATCGACATG | 3302 | TGCAGGACCAGAGAATTCGAATACATGCTACCTNNNGATCGACATG | 3542 |
| TGCAGGACCAGAGAATTCGAATACAATAATGCTNNNGATCGACATG | 3063 | TGCAGGACCAGAGAATTCGAATACACCGACGGTNNNGATCGACATG | 3303 | TGCAGGACCAGAGAATTCGAATACAGTAGCTTGNNNGATCGACATG | 3543 |
| TGCAGGACCAGAGAATTCGAATACAAAGCAGTGNNNGATCGACATG | 3064 | TGCAGGACCAGAGAATTCGAATACATTGCCTTGNNNGATCGACATG | 3304 | TGCAGGACCAGAGAATTCGAATACACCGGATANNNGATCGACATG | 3544 |
| TGCAGGACCAGAGAATTCGAATACAACACGTCANNNGATCGACATG | 3065 | TGCAGGACCAGAGAATTCGAATACAGAGCGCANNNGATCGACATG | 3305 | TGCAGGACCAGAGAATTCGAATACACAGCCGCANNNGATCGACATG | 3545 |
| TGCAGGACCAGAGAATTCGAATACAGTAATACTNNNGATCGACATG | 3066 | TGCAGGACCAGAGAATTCGAATACAGGCCTGCANNNGATCGACATG | 3306 | TGCAGGACCAGAGAATTCGAATACAGATCCTCTNNNGATCGACATG | 3546 |
| TGCAGGACCAGAGAATTCGAATACAAACAAACANNNGATCGACATG | 3067 | TGCAGGACCAGAGAATTCGAATACATCCGTCAAGNNNGATCGACATG | 3307 | TGCAGGACCAGAGAATTCGAATACAAGTACCCANNNGATCGACATG | 3547 |
| TGCAGGACCAGAGAATTCGAATACATACATGGCNNNGATCGACATG | 3068 | TGCAGGACCAGAGAATTCGAATACAGGACGGCANNNGATCGACATG | 3308 | TGCAGGACCAGAGAATTCGAATACAACGGAGTANNNGATCGACATG | 3548 |
| TGCAGGACCAGAGAATTCGAATACACGTGTCAANNNTGCATCAGGT | 3069 | TGCAGGACCAGAGAATTCGAATACAGCATGCCGNNNTGCATCAGGT | 3309 | TGCAGGACCAGAGAATTCGAATACAGTAAAAGTNNNTGCATCAGGT | 3549 |
| TGCAGGACCAGAGAATTCGAATACACTTTAACTNNNTGCATCAGGT | 3070 | TGCAGGACCAGAGAATTCGAATACACGTCTAAGNNNTGCATCAGGT | 3310 | TGCAGGACCAGAGAATTCGAATACATAGGTGTCNNNTGCATCAGGT | 3550 |
| TGCAGGACCAGAGAATTCGAATACAGTAAGGTGNNNTGCATCAGGT | 3071 | TGCAGGACCAGAGAATTCGAATACAGCGTGATTNNNTGCATCAGGT | 3311 | TGCAGGACCAGAGAATTCGAATACATAGACCGTNNNTGCATCAGGT | 3551 |
| TGCAGGACCAGAGAATTCGAATACAGAATAGCGNNNTGCATCAGGT | 3072 | TGCAGGACCAGAGAATTCGAATACATTAGTCCCNNNTGCATCAGGT | 3312 | TGCAGGACCAGAGAATTCGAATACAGCTCGTTTNNNTGCATCAGGT | 3552 |
| TGCAGGACCAGAGAATTCGAATACATAATTAATNNNTGCATCAGGT | 3073 | TGCAGGACCAGAGAATTCGAATACATGGCATTGNNNTGCATCAGGT | 3313 | TGCAGGACCAGAGAATTCGAATACAAAATCTGNNNTGCATCAGGT | 3553 |
| TGCAGGACCAGAGAATTCGAATACACTCTTGTGNNNTGCATCAGGT | 3074 | TGCAGGACCAGAGAATTCGAATACAGACCGTGGNNNTGCATCAGGT | 3314 | TGCAGGACCAGAGAATTCGAATACAGACCAACTNNNTGCATCAGGT | 3554 |
| TGCAGGACCAGAGAATTCGAATACATGCGCGTGNNNTGCATCAGGT | 3075 | TGCAGGACCAGAGAATTCGAATACAGCGCTTTTNNNTGCATCAGGT | 3315 | TGCAGGACCAGAGAATTCGAATACATCACCTACNNNTGCATCAGGT | 3555 |
| TGCAGGACCAGAGAATTCGAATACAGACGAAACNNNTGCATCAGGT | 3076 | TGCAGGACCAGAGAATTCGAATACACGTGGACCNNNTGCATCAGGT | 3316 | TGCAGGACCAGAGAATTCGAATACAGTTAATTGNNNTGCATCAGGT | 3556 |
| TGCAGGACCAGAGAATTCGAATACACGTTTAGGNNNTGCATCAGGT | 3077 | TGCAGGACCAGAGAATTCGAATACAATGTCTTTNNNTGCATCAGGT | 3317 | TGCAGGACCAGAGAATTCGAATACAGCAATTATNNNTGCATCAGGT | 3557 |
| TGCAGGACCAGAGAATTCGAATACAGTAGCCTANNNTGCATCAGGT | 3078 | TGCAGGACCAGAGAATTCGAATACATGAAAGCGNNNTGCATCAGGT | 3318 | TGCAGGACCAGAGAATTCGAATACAAACGAGACNNNTGCATCAGGT | 3558 |
| TGCAGGACCAGAGAATTCGAATACAATTCCCTGNNNTGCATCAGGT | 3079 | TGCAGGACCAGAGAATTCGAATACACCGTGCGANNNTGCATCAGGT | 3319 | TGCAGGACCAGAGAATTCGAATACAATCGGCATNNNTGCATCAGGT | 3559 |
| TGCAGGACCAGAGAATTCGAATACAACGAAATNNNTGCATCAGGT | 3080 | TGCAGGACCAGAGAATTCGAATACATACAACATNNNTGCATCAGGT | 3320 | TGCAGGACCAGAGAATTCGAATACACACACGGNNNTGCATCAGGT | 3560 |
| TGCAGGACCAGAGAATTCGAATACAACCCCCCNNNTGCATCAGGT | 3081 | TGCAGGACCAGAGAATTCGAATACAATTACTCTNNNTGCATCAGGT | 3321 | TGCAGGACCAGAGAATTCGAATACAGCCAGGANNNTGCATCAGGT | 3561 |
| TGCAGGACCAGAGAATTCGAATACATATGATANNNTGCATCAGGT | 3082 | TGCAGGACCAGAGAATTCGAATACAATTCCCTANNNTGCATCAGGT | 3322 | TGCAGGACCAGAGAATTCGAATACAGAGGAGTTNNNTGCATCAGGT | 3562 |
| TGCAGGACCAGAGAATTCGAATACATACATGATNNNTGCATCAGGT | 3083 | TGCAGGACCAGAGAATTCGAATACACACACGGCNNNTGCATCAGGT | 3323 | TGCAGGACCAGAGAATTCGAATACACCACCGCTNNNTGCATCAGGT | 3563 |
| TGCAGGACCAGAGAATTCGAATACATGTACATANNNTGCATCAGGT | 3084 | TGCAGGACCAGAGAATTCGAATACATAGAATTCNNNTGCATCAGGT | 3324 | TGCAGGACCAGAGAATTCGAATACACGATGAGNNNTGCATCAGGT | 3564 |
| TGCAGGACCAGAGAATTCGAATACATACGAAAANNNTGCATCAGGT | 3085 | TGCAGGACCAGAGAATTCGAATACACTTGAAGGNNNTGCATCAGGT | 3325 | TGCAGGACCAGAGAATTCGAATACATTAGCATANNNTGCATCAGGT | 3565 |
| TGCAGGACCAGAGAATTCGAATACACATAACATNNNTGCATCAGGT | 3086 | TGCAGGACCAGAGAATTCGAATACACTTAACTTNNNTGCATCAGGT | 3326 | TGCAGGACCAGAGAATTCGAATACAAGTCCCAANNNTGCATCAGGT | 3566 |

FIG. 16G

| Pool-13 | SEQ ID NO: | Pool-14 | SEQ ID NO: | Pool-15 | SEQ ID NO: |
|---|---|---|---|---|---|
| TGCAGGACCAGAGAATTCGAATACAGGAGAATCNNNTGCATCAGGT | 3087 | TGCAGGACCAGAGAATTCGAATACAACTTACCCNNNTGCATCAGGT | 3327 | TGCAGGACCAGAGAATTCGAATACAAGCCTCTTNNNTGCATCAGGT | 3567 |
| TGCAGGACCAGAGAATTCGAATACATCTTGTCGNNNTGCATCAGGT | 3088 | TGCAGGACCAGAGAATTCGAATACAGAGTTCGTNNNTGCATCAGGT | 3328 | TGCAGGACCAGAGAATTCGAATACATCACCATCNNNTGCATCAGGT | 3568 |
| TGCAGGACCAGAGAATTCGAATACATAAGCGCTNNNTGCATCAGGT | 3089 | TGCAGGACCAGAGAATTCGAATACATTTCCAATNNNTGCATCAGGT | 3329 | TGCAGGACCAGAGAATTCGAATACACTCATCACNNNTGCATCAGGT | 3569 |
| TGCAGGACCAGAGAATTCGAATACATTCTAGAANNNTGCATCAGGT | 3090 | TGCAGGACCAGAGAATTCGAATACAATAAGTTCNNNTGCATCAGGT | 3330 | TGCAGGACCAGAGAATTCGAATACAACGGCGAGNNNTGCATCAGGT | 3570 |
| TGCAGGACCAGAGAATTCGAATACATTGCTTGCNNNTGCATCAGGT | 3091 | TGCAGGACCAGAGAATTCGAATACAAATGTACTNNNTGCATCAGGT | 3331 | TGCAGGACCAGAGAATTCGAATACACTCGGACGNNNTGCATCAGGT | 3571 |
| TGCAGGACCAGAGAATTCGAATACACAGCGTATNNNTGCATCAGGT | 3092 | TGCAGGACCAGAGAATTCGAATACATCCAAGCNNNTGCATCAGGT | 3332 | TGCAGGACCAGAGAATTCGAATACATACGGCATNNNTGCATCAGGT | 3572 |
| TGCAGGACCAGAGAATTCGAATACAAAGGAGCTNNNTGCATCAGGT | 3093 | TGCAGGACCAGAGAATTCGAATACATCGACCAANNNTGCATCAGGT | 3333 | TGCAGGACCAGAGAATTCGAATACATTTAGTAGNNNTGCATCAGGT | 3573 |
| TGCAGGACCAGAGAATTCGAATACACATGCCTTNNNTGCATCAGGT | 3094 | TGCAGGACCAGAGAATTCGAATACACTCGATAGNNNTGCATCAGGT | 3334 | TGCAGGACCAGAGAATTCGAATACAAGGAAGAGNNNTGCATCAGGT | 3574 |
| TGCAGGACCAGAGAATTCGAATACACGCGGTGTNNNTGCATCAGGT | 3095 | TGCAGGACCAGAGAATTCGAATACAACTTCCCANNNTGCATCAGGT | 3335 | TGCAGGACCAGAGAATTCGAATACACCGCGCAANNNTGCATCAGGT | 3575 |
| TGCAGGACCAGAGAATTCGAATACACTGAAAGGNNNTGCATCAGGT | 3096 | TGCAGGACCAGAGAATTCGAATACATTAGATTGNNNTGCATCAGGT | 3336 | TGCAGGACCAGAGAATTCGAATACAGTCGTGGCNNNTGCATCAGGT | 3576 |
| TGCAGGACCAGAGAATTCGAATACAAGTTACGCNNNTGCATCAGGT | 3097 | TGCAGGACCAGAGAATTCGAATACACATTGCCANNNTGCATCAGGT | 3337 | TGCAGGACCAGAGAATTCGAATACAATACACTANNNTGCATCAGGT | 3577 |
| TGCAGGACCAGAGAATTCGAATACAGCTAAGCTNNNTGCATCAGGT | 3098 | TGCAGGACCAGAGAATTCGAATACACAGCACATNNNTGCATCAGGT | 3338 | TGCAGGACCAGAGAATTCGAATACACCACGCCTNNNTGCATCAGGT | 3578 |
| TGCAGGACCAGAGAATTCGAATACATCGCAGTANNNTGCATCAGGT | 3099 | TGCAGGACCAGAGAATTCGAATACACCCGGCAANNNTGCATCAGGT | 3339 | TGCAGGACCAGAGAATTCGAATACACGAAGTGGNNNTGCATCAGGT | 3579 |
| TGCAGGACCAGAGAATTCGAATACACAGATCGTNNNTGCATCAGGT | 3100 | TGCAGGACCAGAGAATTCGAATACAACAGATGGNNNTGCATCAGGT | 3340 | TGCAGGACCAGAGAATTCGAATACAGAGTTGTCNNNTGCATCAGGT | 3580 |
| TGCAGGACCAGAGAATTCGAATACACGAAAATNNNTGCATCAGGT | 3101 | TGCAGGACCAGAGAATTCGAATACATGCGTATGNNNTGCATCAGGT | 3341 | TGCAGGACCAGAGAATTCGAATACACCCGGCTTNNNTGCATCAGGT | 3581 |
| TGCAGGACCAGAGAATTCGAATACAGCCAGACCNNNTGCATCAGGT | 3102 | TGCAGGACCAGAGAATTCGAATACAACAGGAGTNNNTGCATCAGGT | 3342 | TGCAGGACCAGAGAATTCGAATACACAGATAGGNNNTGCATCAGGT | 3582 |
| TGCAGGACCAGAGAATTCGAATACAGCTGCACGNNNTGCATCAGGT | 3103 | TGCAGGACCAGAGAATTCGAATACACATCCATCNNNTGCATCAGGT | 3343 | TGCAGGACCAGAGAATTCGAATACAAAGTCCGTNNNTGCATCAGGT | 3583 |
| TGCAGGACCAGAGAATTCGAATACACTGGAACTNNNTGCATCAGGT | 3104 | TGCAGGACCAGAGAATTCGAATACACTACGCCCNNNTGCATCAGGT | 3344 | TGCAGGACCAGAGAATTCGAATACAAATCAGAANNNTGCATCAGGT | 3584 |
| TGCAGGACCAGAGAATTCGAATACAATAGCAAANNNTGCATCAGGT | 3105 | TGCAGGACCAGAGAATTCGAATACAGACCTACANNNTGCATCAGGT | 3345 | TGCAGGACCAGAGAATTCGAATACACACTCAGANNNTGCATCAGGT | 3585 |
| TGCAGGACCAGAGAATTCGAATACAGAGCTATNNNTGCATCAGGT | 3106 | TGCAGGACCAGAGAATTCGAATACATCCCACCGNNNTGCATCAGGT | 3346 | TGCAGGACCAGAGAATTCGAATACATTATTCCANNNTGCATCAGGT | 3586 |
| TGCAGGACCAGAGAATTCGAATACAAGGTATCCNNNTGCATCAGGT | 3107 | TGCAGGACCAGAGAATTCGAATACACATTCGCTNNNTGCATCAGGT | 3347 | TGCAGGACCAGAGAATTCGAATACAAAGTAACANNNTGCATCAGGT | 3587 |
| TGCAGGACCAGAGAATTCGAATACATTGGAGTCNNNTGCATCAGGT | 3108 | TGCAGGACCAGAGAATTCGAATACAGATCTGGTNNNTGCATCAGGT | 3348 | TGCAGGACCAGAGAATTCGAATACATTGTGCCTNNNTGCATCAGGT | 3588 |
| TGCAGGACCAGAGAATTCGAATACACGGCTTCCNNNTGCATCAGGT | 3109 | TGCAGGACCAGAGAATTCGAATACATATCGTTNNNTGCATCAGGT | 3349 | TGCAGGACCAGAGAATTCGAATACAAAGAGTCGNNNTGCATCAGGT | 3589 |
| TGCAGGACCAGAGAATTCGAATACATCAGGTTCNNNTGCATCAGGT | 3110 | TGCAGGACCAGAGAATTCGAATACAGGATTCTGNNNTGCATCAGGT | 3350 | TGCAGGACCAGAGAATTCGAATACAAGCTGTTGNNNTGCATCAGGT | 3590 |
| TGCAGGACCAGAGAATTCGAATACACGGCGCGCNNNTGCATCAGGT | 3111 | TGCAGGACCAGAGAATTCGAATACACCGCATCCNNNTGCATCAGGT | 3351 | TGCAGGACCAGAGAATTCGAATACAATATTGACNNNTGCATCAGGT | 3591 |
| TGCAGGACCAGAGAATTCGAATACAATGTGTCCNNNTGCATCAGGT | 3112 | TGCAGGACCAGAGAATTCGAATACAGACTAAAANNNTGCATCAGGT | 3352 | TGCAGGACCAGAGAATTCGAATACAAAATATTTNNNTGCATCAGGT | 3592 |
| TGCAGGACCAGAGAATTCGAATACACTTTGGAGNNNTGCATCAGGT | 3113 | TGCAGGACCAGAGAATTCGAATACAGTGGATGTNNNTGCATCAGGT | 3353 | TGCAGGACCAGAGAATTCGAATACACTCAAGACNNNTGCATCAGGT | 3593 |
| TGCAGGACCAGAGAATTCGAATACACGCCCACTNNNTGCATCAGGT | 3114 | TGCAGGACCAGAGAATTCGAATACACCGTTTACNNNTGCATCAGGT | 3354 | TGCAGGACCAGAGAATTCGAATACAAGACGAACNNNTGCATCAGGT | 3594 |
| TGCAGGACCAGAGAATTCGAATACAAACACTGCNNNTGCATCAGGT | 3115 | TGCAGGACCAGAGAATTCGAATACAAATTATCGNNNTGCATCAGGT | 3355 | TGCAGGACCAGAGAATTCGAATACAAGGCAGGCNNNTGCATCAGGT | 3595 |
| TGCAGGACCAGAGAATTCGAATACAGCGCCGTANNNTGCATCAGGT | 3116 | TGCAGGACCAGAGAATTCGAATACACACTCGAANNNTGCATCAGGT | 3356 | TGCAGGACCAGAGAATTCGAATACAACTTATAGNNNTGCATCAGGT | 3596 |
| TGCAGGACCAGAGAATTCGAATACAGTAGCATCNNNTGCATCAGGT | 3117 | TGCAGGACCAGAGAATTCGAATACAGAACGTTCNNNTGCATCAGGT | 3357 | TGCAGGACCAGAGAATTCGAATACACTACTAAANNNTGCATCAGGT | 3597 |
| TGCAGGACCAGAGAATTCGAATACATGCAGCATNNNTGCATCAGGT | 3118 | TGCAGGACCAGAGAATTCGAATACAACCCGCAGNNNTGCATCAGGT | 3358 | TGCAGGACCAGAGAATTCGAATACATTTAGAGTNNNTGCATCAGGT | 3598 |
| TGCAGGACCAGAGAATTCGAATACATGCAGACTNNNTGCATCAGGT | 3119 | TGCAGGACCAGAGAATTCGAATACAGTCTCTGTNNNTGCATCAGGT | 3359 | TGCAGGACCAGAGAATTCGAATACACTGCTTCANNNTGCATCAGGT | 3599 |

FIG. 16H

| Pool-13 | SEQ ID NO: | Pool-14 | SEQ ID NO: | Pool-15 | SEQ ID NO: |
|---|---|---|---|---|---|
| TGCAGGACCAGAGAATTCGAATACAAAGATGCGNNNTGCATCAGGT | 3120 | TGCAGGACCAGAGAATTCGAATACAATTGATCANNNTGCATCAGGT | 3360 | TGCAGGACCAGAGAATTCGAATACAAGGTTCTGNNNTGCATCAGGT | 3600 |
| TGCAGGACCAGAGAATTCGAATACAAACATATCNNNTGCATCAGGT | 3121 | TGCAGGACCAGAGAATTCGAATACAAAGTTTACNNNTGCATCAGGT | 3361 | TGCAGGACCAGAGAATTCGAATACAAGTAGGTGNNNTGCATCAGGT | 3601 |
| TGCAGGACCAGAGAATTCGAATACATGGAACGANNNTGCATCAGGT | 3122 | TGCAGGACCAGAGAATTCGAATACATGTTGTAANNNTGCATCAGGT | 3362 | TGCAGGACCAGAGAATTCGAATACACCCGATAANNNTGCATCAGGT | 3602 |
| TGCAGGACCAGAGAATTCGAATACATGCTCTTGNNNTGCATCAGGT | 3123 | TGCAGGACCAGAGAATTCGAATACACTCTCAACNNNTGCATCAGGT | 3363 | TGCAGGACCAGAGAATTCGAATACACAGAGTGANNNTGCATCAGGT | 3603 |
| TGCAGGACCAGAGAATTCGAATACAACTCCTGTNNNTGCATCAGGT | 3124 | TGCAGGACCAGAGAATTCGAATACAAACGGCCCNNNTGCATCAGGT | 3364 | TGCAGGACCAGAGAATTCGAATACAGTTCGCTTNNNTGCATCAGGT | 3604 |
| TGCAGGACCAGAGAATTCGAATACAAAACGTGGNNNTGCATCAGGT | 3125 | TGCAGGACCAGAGAATTCGAATACAAATGGTAANNNTGCATCAGGT | 3365 | TGCAGGACCAGAGAATTCGAATACAGTTATCAANNNTGCATCAGGT | 3605 |
| TGCAGGACCAGAGAATTCGAATACATGTCCCTANNNTGCATCAGGT | 3126 | TGCAGGACCAGAGAATTCGAATACATACAACCGNNNTGCATCAGGT | 3366 | TGCAGGACCAGAGAATTCGAATACAAGATGCTCNNNTGCATCAGGT | 3606 |
| TGCAGGACCAGAGAATTCGAATACAAATCGCTGNNNTGCATCAGGT | 3127 | TGCAGGACCAGAGAATTCGAATACAATACGGTCNNNTGCATCAGGT | 3367 | TGCAGGACCAGAGAATTCGAATACAAACGTAAANNNTGCATCAGGT | 3607 |
| TGCAGGACCAGAGAATTCGAATACAGAAGCATGNNNTGCATCAGGT | 3128 | TGCAGGACCAGAGAATTCGAATACATGCGCTGGNNNTGCATCAGGT | 3368 | TGCAGGACCAGAGAATTCGAATACAGCATTTCCNNNTGCATCAGGT | 3608 |

FIG. 17A

| Pool-16 | SEQ ID NO: | Pool-17 | SEQ ID NO: | Pool-18 | SEQ ID NO: |
|---|---|---|---|---|---|
| TGCAGGACCAGAGAATTCGAATACATGATTCAANNNACGTATGCCA | 3609 | TGCAGGACCAGAGAATTCGAATACAATTTCCCGNNNACGTATGCCA | 3849 | TGCAGGACCAGAGAATTCGAATACAACGAGACANNNACGTATGCCA | 4089 |
| TGCAGGACCAGAGAATTCGAATACAACAAGTAANNNACGTATGCCA | 3610 | TGCAGGACCAGAGAATTCGAATACAATCCCAGANNNACGTATGCCA | 3850 | TGCAGGACCAGAGAATTCGAATACACGCTAATGNNNACGTATGCCA | 4090 |
| TGCAGGACCAGAGAATTCGAATACAATGACCGTNNNACGTATGCCA | 3611 | TGCAGGACCAGAGAATTCGAATACACGGAGACGNNNACGTATGCCA | 3851 | TGCAGGACCAGAGAATTCGAATACATACGTCGANNNACGTATGCCA | 4091 |
| TGCAGGACCAGAGAATTCGAATACAATCTCGTNNNACGTATGCCA | 3612 | TGCAGGACCAGAGAATTCGAATACACGATACGTNNNACGTATGCCA | 3852 | TGCAGGACCAGAGAATTCGAATACAATTCGTGNNNACGTATGCCA | 4092 |
| TGCAGGACCAGAGAATTCGAATACAGGCAACAANNNACGTATGCCA | 3613 | TGCAGGACCAGAGAATTCGAATACATCCTGCTANNNACGTATGCCA | 3853 | TGCAGGACCAGAGAATTCGAATACAATAGAGGTNNNACGTATGCCA | 4093 |
| TGCAGGACCAGAGAATTCGAATACAAGGCGCCTNNNACGTATGCCA | 3614 | TGCAGGACCAGAGAATTCGAATACAAATTACACNNNACGTATGCCA | 3854 | TGCAGGACCAGAGAATTCGAATACAGGCGGTTCNNNACGTATGCCA | 4094 |
| TGCAGGACCAGAGAATTCGAATACATGCTTACCNNNACGTATGCCA | 3615 | TGCAGGACCAGAGAATTCGAATACATTTCCGACNNNACGTATGCCA | 3855 | TGCAGGACCAGAGAATTCGAATACAATAGGCTCNNNACGTATGCCA | 4095 |
| TGCAGGACCAGAGAATTCGAATACACGCACGACNNNACGTATGCCA | 3616 | TGCAGGACCAGAGAATTCGAATACACTCCCCTNNNACGTATGCCA | 3856 | TGCAGGACCAGAGAATTCGAATACATCCAATTTNNNACGTATGCCA | 4096 |
| TGCAGGACCAGAGAATTCGAATACAGAGGCTTTNNNACGTATGCCA | 3617 | TGCAGGACCAGAGAATTCGAATACAACAATTCANNNACGTATGCCA | 3857 | TGCAGGACCAGAGAATTCGAATACACTGCCGAGNNNACGTATGCCA | 4097 |
| TGCAGGACCAGAGAATTCGAATACACATTCATTNNNACGTATGCCA | 3618 | TGCAGGACCAGAGAATTCGAATACAAGCAGCGGNNNACGTATGCCA | 3858 | TGCAGGACCAGAGAATTCGAATACACTGTAGTGNNNACGTATGCCA | 4098 |
| TGCAGGACCAGAGAATTCGAATACACBATCATANNNACGTATGCCA | 3619 | TGCAGGACCAGAGAATTCGAATACAATCCGATGNNNACGTATGCCA | 3859 | TGCAGGACCAGAGAATTCGAATACAAACGGTCTNNNACGTATGCCA | 4099 |
| TGCAGGACCAGAGAATTCGAATACACTACGATGNNNACGTATGCCA | 3620 | TGCAGGACCAGAGAATTCGAATACACACGCACANNNACGTATGCCA | 3860 | TGCAGGACCAGAGAATTCGAATACACAGGCGTCNNNACGTATGCCA | 4100 |
| TGCAGGACCAGAGAATTCGAATACAGAGGTACANNNACGTATGCCA | 3621 | TGCAGGACCAGAGAATTCGAATACACCACCATTNNNACGTATGCCA | 3861 | TGCAGGACCAGAGAATTCGAATACACTTGCCTANNNACGTATGCCA | 4101 |
| TGCAGGACCAGAGAATTCGAATACACTCGTCTANNNACGTATGCCA | 3622 | TGCAGGACCAGAGAATTCGAATACAAAAGGTCGNNNACGTATGCCA | 3862 | TGCAGGACCAGAGAATTCGAATACACTTCCGTANNNACGTATGCCA | 4102 |
| TGCAGGACCAGAGAATTCGAATACAAGAAGGAGNNNACGTATGCCA | 3623 | TGCAGGACCAGAGAATTCGAATACAGCAGTGTTNNNACGTATGCCA | 3863 | TGCAGGACCAGAGAATTCGAATACACAGACGTTNNNACGTATGCCA | 4103 |
| TGCAGGACCAGAGAATTCGAATACAGTGACATCNNNACGTATGCCA | 3624 | TGCAGGACCAGAGAATTCGAATACATCGAACTGNNNACGTATGCCA | 3864 | TGCAGGACCAGAGAATTCGAATACAAGGAACGTNNNACGTATGCCA | 4104 |
| TGCAGGACCAGAGAATTCGAATACAGCGGTGANNNACGTATGCCA | 3625 | TGCAGGACCAGAGAATTCGAATACATTCGCTANNNACGTATGCCA | 3865 | TGCAGGACCAGAGAATTCGAATACATTGCGTAGNNNACGTATGCCA | 4105 |
| TGCAGGACCAGAGAATTCGAATACACACAAATTNNNACGTATGCCA | 3626 | TGCAGGACCAGAGAATTCGAATACATATTCATCNNNACGTATGCCA | 3866 | TGCAGGACCAGAGAATTCGAATACAGCCCGATGNNNACGTATGCCA | 4106 |
| TGCAGGACCAGAGAATTCGAATACACCGTGCAGNNNACGTATGCCA | 3627 | TGCAGGACCAGAGAATTCGAATACAAACTACTNNNACGTATGCCA | 3867 | TGCAGGACCAGAGAATTCGAATACAAACGTCTGNNNACGTATGCCA | 4107 |
| TGCAGGACCAGAGAATTCGAATACAAAATTACCNNNACGTATGCCA | 3628 | TGCAGGACCAGAGAATTCGAATACAGCCCGTAGNNNACGTATGCCA | 3868 | TGCAGGACCAGAGAATTCGAATACACTCTACACNNNACGTATGCCA | 4108 |
| TGCAGGACCAGAGAATTCGAATACAGCAGACAANNNACGTATGCCA | 3629 | TGCAGGACCAGAGAATTCGAATACAAGTCGTGNNNACGTATGCCA | 3869 | TGCAGGACCAGAGAATTCGAATACAACGGGTCNNNACGTATGCCA | 4109 |
| TGCAGGACCAGAGAATTCGAATACATTCTAAGANNNACGTATGCCA | 3630 | TGCAGGACCAGAGAATTCGAATACATGACAGCTNNNACGTATGCCA | 3870 | TGCAGGACCAGAGAATTCGAATACACATCCAGANNNACGTATGCCA | 4110 |
| TGCAGGACCAGAGAATTCGAATACACATTGAGCNNNACGTATGCCA | 3631 | TGCAGGACCAGAGAATTCGAATACATCAGCGATNNNACGTATGCCA | 3871 | TGCAGGACCAGAGAATTCGAATACAAAGTCGAGNNNACGTATGCCA | 4111 |
| TGCAGGACCAGAGAATTCGAATACAATGAGAGCNNNACGTATGCCA | 3632 | TGCAGGACCAGAGAATTCGAATACAGAGTAAATNNNACGTATGCCA | 3872 | TGCAGGACCAGAGAATTCGAATACAGGCAGCCTNNNACGTATGCCA | 4112 |
| TGCAGGACCAGAGAATTCGAATACATTTCCCGANNNACGTATGCCA | 3633 | TGCAGGACCAGAGAATTCGAATACAGCTGCCTCNNNACGTATGCCA | 3873 | TGCAGGACCAGAGAATTCGAATACATTATACAGNNNACGTATGCCA | 4113 |
| TGCAGGACCAGAGAATTCGAATACATTGCGAACNNNACGTATGCCA | 3634 | TGCAGGACCAGAGAATTCGAATACACTTGACGANNNACGTATGCCA | 3874 | TGCAGGACCAGAGAATTCGAATACACCCGTCGTNNNACGTATGCCA | 4114 |
| TGCAGGACCAGAGAATTCGAATACATGGAGATGNNNACGTATGCCA | 3635 | TGCAGGACCAGAGAATTCGAATACACCTCTTTCNNNACGTATGCCA | 3875 | TGCAGGACCAGAGAATTCGAATACATAATTTAANNNACGTATGCCA | 4115 |
| TGCAGGACCAGAGAATTCGAATACACCAACCCCNNNACGTATGCCA | 3636 | TGCAGGACCAGAGAATTCGAATACAACACAAGGNNNACGTATGCCA | 3876 | TGCAGGACCAGAGAATTCGAATACATCATCATNNNACGTATGCCA | 4116 |
| TGCAGGACCAGAGAATTCGAATACAGACAATGGNNNACGTATGCCA | 3637 | TGCAGGACCAGAGAATTCGAATACATCTCCAGTNNNACGTATGCCA | 3877 | TGCAGGACCAGAGAATTCGAATACACATGTATANNNACGTATGCCA | 4117 |
| TGCAGGACCAGAGAATTCGAATACACAGAGCCCNNNACGTATGCCA | 3638 | TGCAGGACCAGAGAATTCGAATACATATTGGTANNNACGTATGCCA | 3878 | TGCAGGACCAGAGAATTCGAATACAGTAGTTATNNNACGTATGCCA | 4118 |
| TGCAGGACCAGAGAATTCGAATACAAAGAATANNNACGTATGCCA | 3639 | TGCAGGACCAGAGAATTCGAATACAGCTTCATCNNNACGTATGCCA | 3879 | TGCAGGACCAGAGAATTCGAATACATGTATCGGNNNACGTATGCCA | 4119 |
| TGCAGGACCAGAGAATTCGAATACAAGGTAAATNNNACGTATGCCA | 3640 | TGCAGGACCAGAGAATTCGAATACATTCGTTANNNACGTATGCCA | 3880 | TGCAGGACCAGAGAATTCGAATACAAGACGGTGNNNACGTATGCCA | 4120 |

FIG. 17B

| Pool-16 | SEQ ID NO: | Pool-17 | SEQ ID NO: | Pool-18 | SEQ ID NO: |
|---|---|---|---|---|---|
| TGCAGGACCAGAGAATTCGAATACAG CCCCAAGNNNACGTATGCCA | 3641 | TGCAGGACCAGAGAATTCGAATACAT ACGTGACNNNACGTATGCCA | 3881 | TGCAGGACCAGAGAATTCGAATACAG CACAAGANNNACGTATGCCA | 4121 |
| TGCAGGACCAGAGAATTCGAATACAC TGCTTGTNNNACGTATGCCA | 3642 | TGCAGGACCAGAGAATTCGAATACAT GTTGGTGNNNACGTATGCCA | 3882 | TGCAGGACCAGAGAATTCGAATACAA ACCCGGCNNNACGTATGCCA | 4122 |
| TGCAGGACCAGAGAATTCGAATACAA CACGGCCNNNACGTATGCCA | 3643 | TGCAGGACCAGAGAATTCGAATACAT ATCACAGNNNACGTATGCCA | 3883 | TGCAGGACCAGAGAATTCGAATACAT GTGGCTANNNACGTATGCCA | 4123 |
| TGCAGGACCAGAGAATTCGAATACAA CGACCTANNNACGTATGCCA | 3644 | TGCAGGACCAGAGAATTCGAATACAA ACGGCGGNNNACGTATGCCA | 3884 | TGCAGGACCAGAGAATTCGAATACAG TAGCTCANNNACGTATGCCA | 4124 |
| TGCAGGACCAGAGAATTCGAATACAA TTAGAAGNNNACGTATGCCA | 3645 | TGCAGGACCAGAGAATTCGAATACAA ATGTGAANNNACGTATGCCA | 3885 | TGCAGGACCAGAGAATTCGAATACAG GCTGGCTNNNACGTATGCCA | 4125 |
| TGCAGGACCAGAGAATTCGAATACAG CCGTACGNNNACGTATGCCA | 3646 | TGCAGGACCAGAGAATTCGAATACAG TAGCCGCNNNACGTATGCCA | 3886 | TGCAGGACCAGAGAATTCGAATACAT ACAGCTGNNNACGTATGCCA | 4126 |
| TGCAGGACCAGAGAATTCGAATACAC AGAAAGCNNNACGTATGCCA | 3647 | TGCAGGACCAGAGAATTCGAATACAT GTGAATTNNNACGTATGCCA | 3887 | TGCAGGACCAGAGAATTCGAATACAC TTGTGTCNNNACGTATGCCA | 4127 |
| TGCAGGACCAGAGAATTCGAATACAC CACCTTANNNACGTATGCCA | 3648 | TGCAGGACCAGAGAATTCGAATACAC GGTAAGANNNACGTATGCCA | 3888 | TGCAGGACCAGAGAATTCGAATACAA GCATCGTNNNACGTATGCCA | 4128 |
| TGCAGGACCAGAGAATTCGAATACAA AGGATTANNNACGTATGCCA | 3649 | TGCAGGACCAGAGAATTCGAATACAT CTGGTGANNNACGTATGCCA | 3889 | TGCAGGACCAGAGAATTCGAATACAA ATAAAGCNNNACGTATGCCA | 4129 |
| TGCAGGACCAGAGAATTCGAATACAA GCAAATANNNACGTATGCCA | 3650 | TGCAGGACCAGAGAATTCGAATACAG TCCGTTTNNNACGTATGCCA | 3890 | TGCAGGACCAGAGAATTCGAATACAC TATCGGANNNACGTATGCCA | 4130 |
| TGCAGGACCAGAGAATTCGAATACAC ACTTCGTNNNACGTATGCCA | 3651 | TGCAGGACCAGAGAATTCGAATACAC CGTCGAGNNNACGTATGCCA | 3891 | TGCAGGACCAGAGAATTCGAATACAC CGCCCGCNNNACGTATGCCA | 4131 |
| TGCAGGACCAGAGAATTCGAATACAA TTCGTCCNNNACGTATGCCA | 3652 | TGCAGGACCAGAGAATTCGAATACAT CGATCCTNNNACGTATGCCA | 3892 | TGCAGGACCAGAGAATTCGAATACAT CGTTTCGNNNACGTATGCCA | 4132 |
| TGCAGGACCAGAGAATTCGAATACAT TCTTGGCNNNACGTATGCCA | 3653 | TGCAGGACCAGAGAATTCGAATACAT TTGCGTCNNNACGTATGCCA | 3893 | TGCAGGACCAGAGAATTCGAATACAC CTAGCAANNNACGTATGCCA | 4133 |
| TGCAGGACCAGAGAATTCGAATACAT TGGCTCTNNNACGTATGCCA | 3654 | TGCAGGACCAGAGAATTCGAATACAC TCGGCTCNNNACGTATGCCA | 3894 | TGCAGGACCAGAGAATTCGAATACAT GAACATNNNACGTATGCCA | 4134 |
| TGCAGGACCAGAGAATTCGAATACAG GAGACTANNNACGTATGCCA | 3655 | TGCAGGACCAGAGAATTCGAATACAG CCACGCCNNNACGTATGCCA | 3895 | TGCAGGACCAGAGAATTCGAATACAT GTAACATNNNACGTATGCCA | 4135 |
| TGCAGGACCAGAGAATTCGAATACAA ATACTTGNNNACGTATGCCA | 3656 | TGCAGGACCAGAGAATTCGAATACAA CGTGCCGNNNACGTATGCCA | 3896 | TGCAGGACCAGAGAATTCGAATACAG TCGGAAANNNACGTATGCCA | 4136 |
| TGCAGGACCAGAGAATTCGAATACAG CTGTTAGNNNACGTATGCCA | 3657 | TGCAGGACCAGAGAATTCGAATACAT GTGGTACNNNACGTATGCCA | 3897 | TGCAGGACCAGAGAATTCGAATACAG TTGGCCGNNNACGTATGCCA | 4137 |
| TGCAGGACCAGAGAATTCGAATACAA CAACCTGNNNACGTATGCCA | 3658 | TGCAGGACCAGAGAATTCGAATACAA GCCGAAANNNACGTATGCCA | 3898 | TGCAGGACCAGAGAATTCGAATACAG CGATAGANNNACGTATGCCA | 4138 |
| TGCAGGACCAGAGAATTCGAATACAT CGTGCCCNNNACGTATGCCA | 3659 | TGCAGGACCAGAGAATTCGAATACAC TCCTAACNNNACGTATGCCA | 3899 | TGCAGGACCAGAGAATTCGAATACAT TAACGTANNNACGTATGCCA | 4139 |
| TGCAGGACCAGAGAATTCGAATACAG ACTCTCTNNNACGTATGCCA | 3660 | TGCAGGACCAGAGAATTCGAATACAG AAGGCGCNNNACGTATGCCA | 3900 | TGCAGGACCAGAGAATTCGAATACAC CTTATATNNNACGTATGCCA | 4140 |
| TGCAGGACCAGAGAATTCGAATACAT ATAACACNNNACGTATGCCA | 3661 | TGCAGGACCAGAGAATTCGAATACAC GTTCACTNNNACGTATGCCA | 3901 | TGCAGGACCAGAGAATTCGAATACAA AACAGATNNNACGTATGCCA | 4141 |
| TGCAGGACCAGAGAATTCGAATACAT GAGCCTANNNACGTATGCCA | 3662 | TGCAGGACCAGAGAATTCGAATACAG AGATGTGNNNACGTATGCCA | 3902 | TGCAGGACCAGAGAATTCGAATACAT ACCCATCNNNACGTATGCCA | 4142 |
| TGCAGGACCAGAGAATTCGAATACAC AGACGAANNNACGTATGCCA | 3663 | TGCAGGACCAGAGAATTCGAATACAG CTCACTTNNNACGTATGCCA | 3903 | TGCAGGACCAGAGAATTCGAATACAA AAAGAGANNNACGTATGCCA | 4143 |
| TGCAGGACCAGAGAATTCGAATACAC GGAATGANNNACGTATGCCA | 3664 | TGCAGGACCAGAGAATTCGAATACAC GAAGCTTNNNACGTATGCCA | 3904 | TGCAGGACCAGAGAATTCGAATACAC GTTCGAANNNACGTATGCCA | 4144 |
| TGCAGGACCAGAGAATTCGAATACAG GTGATGANNNACGTATGCCA | 3665 | TGCAGGACCAGAGAATTCGAATACAT ACTCGAGNNNACGTATGCCA | 3905 | TGCAGGACCAGAGAATTCGAATACAA TGGATCCNNNACGTATGCCA | 4145 |
| TGCAGGACCAGAGAATTCGAATACAC ACCTCTANNNACGTATGCCA | 3666 | TGCAGGACCAGAGAATTCGAATACAT TCTTGTANNNACGTATGCCA | 3906 | TGCAGGACCAGAGAATTCGAATACAG CTCGATANNNACGTATGCCA | 4146 |
| TGCAGGACCAGAGAATTCGAATACAA CTGGTACNNNACGTATGCCA | 3667 | TGCAGGACCAGAGAATTCGAATACAG AAGAAGGNNNACGTATGCCA | 3907 | TGCAGGACCAGAGAATTCGAATACAT GTAACCGNNNACGTATGCCA | 4147 |
| TGCAGGACCAGAGAATTCGAATACAG CAAATCCNNNACGTATGCCA | 3668 | TGCAGGACCAGAGAATTCGAATACAA GCCACGCNNNACGTATGCCA | 3908 | TGCAGGACCAGAGAATTCGAATACAA TCTACTTNNNACGTATGCCA | 4148 |
| TGCAGGACCAGAGAATTCGAATACAA ATATAAANNNCTAGCGTTAC | 3669 | TGCAGGACCAGAGAATTCGAATACAA TATACCGNNNCTAGCGTTAC | 3909 | TGCAGGACCAGAGAATTCGAATACAG ATCGTACNNNCTAGCGTTAC | 4149 |
| TGCAGGACCAGAGAATTCGAATACAT GGTTATANNNCTAGCGTTAC | 3670 | TGCAGGACCAGAGAATTCGAATACAA GATCTTANNNCTAGCGTTAC | 3910 | TGCAGGACCAGAGAATTCGAATACAT GAACGTCNNNCTAGCGTTAC | 4150 |
| TGCAGGACCAGAGAATTCGAATACAA CCCGCTCNNNCTAGCGTTAC | 3671 | TGCAGGACCAGAGAATTCGAATACAA CAACCCANNNCTAGCGTTAC | 3911 | TGCAGGACCAGAGAATTCGAATACAA CCAACTCNNNCTAGCGTTAC | 4151 |
| TGCAGGACCAGAGAATTCGAATACAT GCGAAAGNNNCTAGCGTTAC | 3672 | TGCAGGACCAGAGAATTCGAATACAT GCTAACGNNNCTAGCGTTAC | 3912 | TGCAGGACCAGAGAATTCGAATACAG CGGAGGTNNNCTAGCGTTAC | 4152 |
| TGCAGGACCAGAGAATTCGAATACAC GTCTGCCNNNCTAGCGTTAC | 3673 | TGCAGGACCAGAGAATTCGAATACAT GTAGTCGNNNCTAGCGTTAC | 3913 | TGCAGGACCAGAGAATTCGAATACAT GCCCATTNNNCTAGCGTTAC | 4153 |

FIG. 17C

| Pool-16 | SEQ ID NO: | Pool-17 | SEQ ID NO: | Pool-18 | SEQ ID NO: |
|---|---|---|---|---|---|
| TGCAGGACCAGAGAATTCGAATACAAGTTGTATNNNCTAGCGTTAC | 3674 | TGCAGGACCAGAGAATTCGAATACAATCGTCGTNNNCTAGCGTTAC | 3914 | TGCAGGACCAGAGAATTCGAATACAACGATCACNNNCTAGCGTTAC | 4154 |
| TGCAGGACCAGAGAATTCGAATACAGGCTACTANNNCTAGCGTTAC | 3675 | TGCAGGACCAGAGAATTCGAATACAAGTAGGACNNNCTAGCGTTAC | 3915 | TGCAGGACCAGAGAATTCGAATACATAAGGTAANNNCTAGCGTTAC | 4155 |
| TGCAGGACCAGAGAATTCGAATACAACATCATANNNCTAGCGTTAC | 3676 | TGCAGGACCAGAGAATTCGAATACAAAAAAAAANNNCTAGCGTTAC | 3916 | TGCAGGACCAGAGAATTCGAATACAACCTACGANNNCTAGCGTTAC | 4156 |
| TGCAGGACCAGAGAATTCGAATACAATTCCAGGNNNCTAGCGTTAC | 3677 | TGCAGGACCAGAGAATTCGAATACAAGTTCATANNNCTAGCGTTAC | 3917 | TGCAGGACCAGAGAATTCGAATACACACACCAANNNCTAGCGTTAC | 4157 |
| TGCAGGACCAGAGAATTCGAATACATTTTGTTGNNNCTAGCGTTAC | 3678 | TGCAGGACCAGAGAATTCGAATACAGAAGGTCANNNCTAGCGTTAC | 3918 | TGCAGGACCAGAGAATTCGAATACATGGTCGGCNNNCTAGCGTTAC | 4158 |
| TGCAGGACCAGAGAATTCGAATACAAGTGGACANNNCTAGCGTTAC | 3679 | TGCAGGACCAGAGAATTCGAATACATGAATGCCNNNCTAGCGTTAC | 3919 | TGCAGGACCAGAGAATTCGAATACATTATCTGTNNNCTAGCGTTAC | 4159 |
| TGCAGGACCAGAGAATTCGAATACAGAGAGGTTNNNCTAGCGTTAC | 3680 | TGCAGGACCAGAGAATTCGAATACAACACCCGGNNNCTAGCGTTAC | 3920 | TGCAGGACCAGAGAATTCGAATACATCGACCGNNNCTAGCGTTAC | 4160 |
| TGCAGGACCAGAGAATTCGAATACACTTCCCGGNNNCTAGCGTTAC | 3681 | TGCAGGACCAGAGAATTCGAATACACTAACGCANNNCTAGCGTTAC | 3921 | TGCAGGACCAGAGAATTCGAATACATACCGATGNNNCTAGCGTTAC | 4161 |
| TGCAGGACCAGAGAATTCGAATACAACCTCCATNNNCTAGCGTTAC | 3682 | TGCAGGACCAGAGAATTCGAATACAACCCCTATNNNCTAGCGTTAC | 3922 | TGCAGGACCAGAGAATTCGAATACAGAACGGATNNNCTAGCGTTAC | 4162 |
| TGCAGGACCAGAGAATTCGAATACACAAGAGGTNNNCTAGCGTTAC | 3683 | TGCAGGACCAGAGAATTCGAATACAAGATAGATNNNCTAGCGTTAC | 3923 | TGCAGGACCAGAGAATTCGAATACATTGTTCTANNNCTAGCGTTAC | 4163 |
| TGCAGGACCAGAGAATTCGAATACAGAAAGTCGNNNCTAGCGTTAC | 3684 | TGCAGGACCAGAGAATTCGAATACAGGAGTGATNNNCTAGCGTTAC | 3924 | TGCAGGACCAGAGAATTCGAATACAGGTCGTCGNNNCTAGCGTTAC | 4164 |
| TGCAGGACCAGAGAATTCGAATACACGCGAAAANNNCTAGCGTTAC | 3685 | TGCAGGACCAGAGAATTCGAATACAATAGAGGCNNNCTAGCGTTAC | 3925 | TGCAGGACCAGAGAATTCGAATACAATGCTTCCNNNCTAGCGTTAC | 4165 |
| TGCAGGACCAGAGAATTCGAATACACCTGGCAGNNNCTAGCGTTAC | 3686 | TGCAGGACCAGAGAATTCGAATACACCCCGCGCNNNCTAGCGTTAC | 3926 | TGCAGGACCAGAGAATTCGAATACATCAGGACTNNNCTAGCGTTAC | 4166 |
| TGCAGGACCAGAGAATTCGAATACAAGCAGATGNNNCTAGCGTTAC | 3687 | TGCAGGACCAGAGAATTCGAATACACCATACTCNNNCTAGCGTTAC | 3927 | TGCAGGACCAGAGAATTCGAATACAAAGACATANNNCTAGCGTTAC | 4167 |
| TGCAGGACCAGAGAATTCGAATACAAGAGGCCGNNNCTAGCGTTAC | 3688 | TGCAGGACCAGAGAATTCGAATACATGATTCCNNNCTAGCGTTAC | 3928 | TGCAGGACCAGAGAATTCGAATACACCATCGTTNNNCTAGCGTTAC | 4168 |
| TGCAGGACCAGAGAATTCGAATACACGTGCGTGNNNCTAGCGTTAC | 3689 | TGCAGGACCAGAGAATTCGAATACAAGAACGGTNNNCTAGCGTTAC | 3929 | TGCAGGACCAGAGAATTCGAATACATAACACGNNNCTAGCGTTAC | 4169 |
| TGCAGGACCAGAGAATTCGAATACATGGTAGGANNNCTAGCGTTAC | 3690 | TGCAGGACCAGAGAATTCGAATACAGCTTCAAGNNNCTAGCGTTAC | 3930 | TGCAGGACCAGAGAATTCGAATACACCTCCTCCNNNCTAGCGTTAC | 4170 |
| TGCAGGACCAGAGAATTCGAATACACGCGCCAANNNCTAGCGTTAC | 3691 | TGCAGGACCAGAGAATTCGAATACAAAATATCCNNNCTAGCGTTAC | 3931 | TGCAGGACCAGAGAATTCGAATACATCGGACTANNNCTAGCGTTAC | 4171 |
| TGCAGGACCAGAGAATTCGAATACATGAGCACTNNNCTAGCGTTAC | 3692 | TGCAGGACCAGAGAATTCGAATACACGTCCCANNNCTAGCGTTAC | 3932 | TGCAGGACCAGAGAATTCGAATACAGGCAAACANNNCTAGCGTTAC | 4172 |
| TGCAGGACCAGAGAATTCGAATACATCATCGTNNNCTAGCGTTAC | 3693 | TGCAGGACCAGAGAATTCGAATACAACTAATCANNNCTAGCGTTAC | 3933 | TGCAGGACCAGAGAATTCGAATACAGGAAACACNNNCTAGCGTTAC | 4173 |
| TGCAGGACCAGAGAATTCGAATACAAGCCAAGANNNCTAGCGTTAC | 3694 | TGCAGGACCAGAGAATTCGAATACATGACGCGNNNCTAGCGTTAC | 3934 | TGCAGGACCAGAGAATTCGAATACATACACTCCNNNCTAGCGTTAC | 4174 |
| TGCAGGACCAGAGAATTCGAATACACGAGGACGNNNCTAGCGTTAC | 3695 | TGCAGGACCAGAGAATTCGAATACAGCCGTGCCANNNCTAGCGTTAC | 3935 | TGCAGGACCAGAGAATTCGAATACACGGACCTGNNNCTAGCGTTAC | 4175 |
| TGCAGGACCAGAGAATTCGAATACATGTGACTGNNNCTAGCGTTAC | 3696 | TGCAGGACCAGAGAATTCGAATACAAAATTGANNNCTAGCGTTAC | 3936 | TGCAGGACCAGAGAATTCGAATACAATCCTGAGNNNCTAGCGTTAC | 4176 |
| TGCAGGACCAGAGAATTCGAATACACCTTGAGNNNCTAGCGTTAC | 3697 | TGCAGGACCAGAGAATTCGAATACATGTTCACCNNNCTAGCGTTAC | 3937 | TGCAGGACCAGAGAATTCGAATACACCCGTCTGNNNCTAGCGTTAC | 4177 |
| TGCAGGACCAGAGAATTCGAATACAGTTAAGTTNNNCTAGCGTTAC | 3698 | TGCAGGACCAGAGAATTCGAATACAATCCGCAANNNCTAGCGTTAC | 3938 | TGCAGGACCAGAGAATTCGAATACAGGCTCAATNNNCTAGCGTTAC | 4178 |
| TGCAGGACCAGAGAATTCGAATACAACCCAGGCNNNCTAGCGTTAC | 3699 | TGCAGGACCAGAGAATTCGAATACATCAGATTANNNCTAGCGTTAC | 3939 | TGCAGGACCAGAGAATTCGAATACAGTGCTTGANNNCTAGCGTTAC | 4179 |
| TGCAGGACCAGAGAATTCGAATACACCGATGATNNNCTAGCGTTAC | 3700 | TGCAGGACCAGAGAATTCGAATACACGCTAAGTNNNCTAGCGTTAC | 3940 | TGCAGGACCAGAGAATTCGAATACAATTAACTGNNNCTAGCGTTAC | 4180 |
| TGCAGGACCAGAGAATTCGAATACAGATCTCGANNNCTAGCGTTAC | 3701 | TGCAGGACCAGAGAATTCGAATACACACACCCTNNNCTAGCGTTAC | 3941 | TGCAGGACCAGAGAATTCGAATACATCCAGATGNNNCTAGCGTTAC | 4181 |
| TGCAGGACCAGAGAATTCGAATACAGAGATGTNNNCTAGCGTTAC | 3702 | TGCAGGACCAGAGAATTCGAATACAAGCCTGTNNNCTAGCGTTAC | 3942 | TGCAGGACCAGAGAATTCGAATACACCGCGCGGNNNCTAGCGTTAC | 4182 |
| TGCAGGACCAGAGAATTCGAATACATAGGTAAANNNCTAGCGTTAC | 3703 | TGCAGGACCAGAGAATTCGAATACAGGTCCAGCNNNCTAGCGTTAC | 3943 | TGCAGGACCAGAGAATTCGAATACACCATAAGCNNNCTAGCGTTAC | 4183 |
| TGCAGGACCAGAGAATTCGAATACAACTCAGCANNNCTAGCGTTAC | 3704 | TGCAGGACCAGAGAATTCGAATACATGTCGCTTNNNCTAGCGTTAC | 3944 | TGCAGGACCAGAGAATTCGAATACAGGTTGGTTNNNCTAGCGTTAC | 4184 |
| TGCAGGACCAGAGAATTCGAATACAAGATAGGCNNNCTAGCGTTAC | 3705 | TGCAGGACCAGAGAATTCGAATACAGAAATTTCNNNCTAGCGTTAC | 3945 | TGCAGGACCAGAGAATTCGAATACAGGCAGATANNNCTAGCGTTAC | 4185 |
| TGCAGGACCAGAGAATTCGAATACACGAATTGCNNNCTAGCGTTAC | 3706 | TGCAGGACCAGAGAATTCGAATACATACGGTGTNNNCTAGCGTTAC | 3946 | TGCAGGACCAGAGAATTCGAATACAATGCAACCNNNCTAGCGTTAC | 4186 |

FIG. 17D

| Pool-16 | SEQ ID NO: | Pool-17 | SEQ ID NO: | Pool-18 | SEQ ID NO: |
|---|---|---|---|---|---|
| TGCAGGACCAGAGAATTCGAATACAT ACCAGGTNNNCTAGCGTTAC | 3707 | TGCAGGACCAGAGAATTCGAATACAC CGACCAGNNNCTAGCGTTAC | 3947 | TGCAGGACCAGAGAATTCGAATACAG CGCGCCGNNNCTAGCGTTAC | 4187 |
| TGCAGGACCAGAGAATTCGAATACAT ATACTCTNNNCTAGCGTTAC | 3708 | TGCAGGACCAGAGAATTCGAATACAT GATAAAGNNNCTAGCGTTAC | 3948 | TGCAGGACCAGAGAATTCGAATACAC AAAGTGGNNNCTAGCGTTAC | 4188 |
| TGCAGGACCAGAGAATTCGAATACAA GCTTCTCNNNCTAGCGTTAC | 3709 | TGCAGGACCAGAGAATTCGAATACAT ATGGCTGNNNCTAGCGTTAC | 3949 | TGCAGGACCAGAGAATTCGAATACAT AAAAGCANNNCTAGCGTTAC | 4189 |
| TGCAGGACCAGAGAATTCGAATACAA CCTGAGTNNNCTAGCGTTAC | 3710 | TGCAGGACCAGAGAATTCGAATACAC CCCTCCTNNNCTAGCGTTAC | 3950 | TGCAGGACCAGAGAATTCGAATACAA TCTGTGGNNNCTAGCGTTAC | 4190 |
| TGCAGGACCAGAGAATTCGAATACAC ATAGATTNNNCTAGCGTTAC | 3711 | TGCAGGACCAGAGAATTCGAATACAT CTTACCGNNNCTAGCGTTAC | 3951 | TGCAGGACCAGAGAATTCGAATACAA GTATATANNNCTAGCGTTAC | 4191 |
| TGCAGGACCAGAGAATTCGAATACAA GCGGAATNNNCTAGCGTTAC | 3712 | TGCAGGACCAGAGAATTCGAATACAG CAATCGTNNNCTAGCGTTAC | 3952 | TGCAGGACCAGAGAATTCGAATACAG GTATTGNNNCTAGCGTTAC | 4192 |
| TGCAGGACCAGAGAATTCGAATACAG GCATGCCNNNCTAGCGTTAC | 3713 | TGCAGGACCAGAGAATTCGAATACAC TAGCGCGNNNCTAGCGTTAC | 3953 | TGCAGGACCAGAGAATTCGAATACAT ACAAACTNNNCTAGCGTTAC | 4193 |
| TGCAGGACCAGAGAATTCGAATACAA ATATCCGNNNCTAGCGTTAC | 3714 | TGCAGGACCAGAGAATTCGAATACAT ACTCTGCNNNCTAGCGTTAC | 3954 | TGCAGGACCAGAGAATTCGAATACAC TCTTAATNNNCTAGCGTTAC | 4194 |
| TGCAGGACCAGAGAATTCGAATACAG CTCAGCGNNNCTAGCGTTAC | 3715 | TGCAGGACCAGAGAATTCGAATACAA TGGCAGANNNCTAGCGTTAC | 3955 | TGCAGGACCAGAGAATTCGAATACAG GTCTGATNNNCTAGCGTTAC | 4195 |
| TGCAGGACCAGAGAATTCGAATACAC TTCAAGGNNNCTAGCGTTAC | 3716 | TGCAGGACCAGAGAATTCGAATACAC GAGGTTTNNNCTAGCGTTAC | 3956 | TGCAGGACCAGAGAATTCGAATACAT CAGGAAGNNNCTAGCGTTAC | 4196 |
| TGCAGGACCAGAGAATTCGAATACAT CAGTAATNNNCTAGCGTTAC | 3717 | TGCAGGACCAGAGAATTCGAATACAC CAGCTAANNNCTAGCGTTAC | 3957 | TGCAGGACCAGAGAATTCGAATACAC ACGCTTTNNNCTAGCGTTAC | 4197 |
| TGCAGGACCAGAGAATTCGAATACAC CGGCCAANNNCTAGCGTTAC | 3718 | TGCAGGACCAGAGAATTCGAATACAT GTGCCGGNNNCTAGCGTTAC | 3958 | TGCAGGACCAGAGAATTCGAATACAG GCGGCAANNNCTAGCGTTAC | 4198 |
| TGCAGGACCAGAGAATTCGAATACAA TGATCATNNNCTAGCGTTAC | 3719 | TGCAGGACCAGAGAATTCGAATACAT GCCGTTTNNNCTAGCGTTAC | 3959 | TGCAGGACCAGAGAATTCGAATACAG AAGTTGGNNNCTAGCGTTAC | 4199 |
| TGCAGGACCAGAGAATTCGAATACAG GCGCGTTNNNCTAGCGTTAC | 3720 | TGCAGGACCAGAGAATTCGAATACAC TCCGTGCNNNCTAGCGTTAC | 3960 | TGCAGGACCAGAGAATTCGAATACAG CAGGTGGNNNCTAGCGTTAC | 4200 |
| TGCAGGACCAGAGAATTCGAATACAC GTCCGCGNNNCTAGCGTTAC | 3721 | TGCAGGACCAGAGAATTCGAATACAC CACAATCNNNCTAGCGTTAC | 3961 | TGCAGGACCAGAGAATTCGAATACAT GTAATCANNNCTAGCGTTAC | 4201 |
| TGCAGGACCAGAGAATTCGAATACAC ACTGGTANNNCTAGCGTTAC | 3722 | TGCAGGACCAGAGAATTCGAATACAC ATCGTGANNNCTAGCGTTAC | 3962 | TGCAGGACCAGAGAATTCGAATACAG TCAACCANNNCTAGCGTTAC | 4202 |
| TGCAGGACCAGAGAATTCGAATACAC TAAGACCNNNCTAGCGTTAC | 3723 | TGCAGGACCAGAGAATTCGAATACAC AAGGTTCNNNCTAGCGTTAC | 3963 | TGCAGGACCAGAGAATTCGAATACAG AGCAACANNNCTAGCGTTAC | 4203 |
| TGCAGGACCAGAGAATTCGAATACAA CGCTACANNNCTAGCGTTAC | 3724 | TGCAGGACCAGAGAATTCGAATACAG AAAGGTCNNNCTAGCGTTAC | 3964 | TGCAGGACCAGAGAATTCGAATACAA CCGTCGGNNNCTAGCGTTAC | 4204 |
| TGCAGGACCAGAGAATTCGAATACAA CCAAAAANNNCTAGCGTTAC | 3725 | TGCAGGACCAGAGAATTCGAATACAA GAAGGTCNNNCTAGCGTTAC | 3965 | TGCAGGACCAGAGAATTCGAATACAT AGGCGCCNNNCTAGCGTTAC | 4205 |
| TGCAGGACCAGAGAATTCGAATACAC GAGTGCCNNNCTAGCGTTAC | 3726 | TGCAGGACCAGAGAATTCGAATACAC CATGCTTNNNCTAGCGTTAC | 3966 | TGCAGGACCAGAGAATTCGAATACAG AAGCAGTNNNCTAGCGTTAC | 4206 |
| TGCAGGACCAGAGAATTCGAATACAA ACCGAANNNCTAGCGTTAC | 3727 | TGCAGGACCAGAGAATTCGAATACAT TCAACTNNNCTAGCGTTAC | 3967 | TGCAGGACCAGAGAATTCGAATACAT TGGTATANNNCTAGCGTTAC | 4207 |
| TGCAGGACCAGAGAATTCGAATACAC AAAGCATNNNCTAGCGTTAC | 3728 | TGCAGGACCAGAGAATTCGAATACAT CTGGCAANNNCTAGCGTTAC | 3968 | TGCAGGACCAGAGAATTCGAATACAG AAGTGTGNNNCTAGCGTTAC | 4208 |
| TGCAGGACCAGAGAATTCGAATACAC CCCCGGNNNGATCGACATG | 3729 | TGCAGGACCAGAGAATTCGAATACAG TTTACAANNNGATCGACATG | 3969 | TGCAGGACCAGAGAATTCGAATACAC TGCTTTGNNNGATCGACATG | 4209 |
| TGCAGGACCAGAGAATTCGAATACAT TGGTTGGNNNGATCGACATG | 3730 | TGCAGGACCAGAGAATTCGAATACAA CCCACANNNGATCGACATG | 3970 | TGCAGGACCAGAGAATTCGAATACAG TTCCGCCNNNGATCGACATG | 4210 |
| TGCAGGACCAGAGAATTCGAATACAT CCACGTTNNNGATCGACATG | 3731 | TGCAGGACCAGAGAATTCGAATACAG GCTCATANNNGATCGACATG | 3971 | TGCAGGACCAGAGAATTCGAATACAC GACTATGNNNGATCGACATG | 4211 |
| TGCAGGACCAGAGAATTCGAATACAA TGAAGTANNNGATCGACATG | 3732 | TGCAGGACCAGAGAATTCGAATACAA GCATTGCNNNGATCGACATG | 3972 | TGCAGGACCAGAGAATTCGAATACAC TGTAGCANNNGATCGACATG | 4212 |
| TGCAGGACCAGAGAATTCGAATACAA CAATAAGNNNGATCGACATG | 3733 | TGCAGGACCAGAGAATTCGAATACAA ACCCGATNNNGATCGACATG | 3973 | TGCAGGACCAGAGAATTCGAATACAC GCGGTCANNNGATCGACATG | 4213 |
| TGCAGGACCAGAGAATTCGAATACAC ATGTTTNNNGATCGACATG | 3734 | TGCAGGACCAGAGAATTCGAATACAT GACCAACNNNGATCGACATG | 3974 | TGCAGGACCAGAGAATTCGAATACAT CCATGAGNNNGATCGACATG | 4214 |
| TGCAGGACCAGAGAATTCGAATACAT CCGGTCCNNNGATCGACATG | 3735 | TGCAGGACCAGAGAATTCGAATACAT CCGAGGANNNGATCGACATG | 3975 | TGCAGGACCAGAGAATTCGAATACAC GCTCCCTNNNGATCGACATG | 4215 |
| TGCAGGACCAGAGAATTCGAATACAG TTACGTGNNNGATCGACATG | 3736 | TGCAGGACCAGAGAATTCGAATACAA ATATGGANNNGATCGACATG | 3976 | TGCAGGACCAGAGAATTCGAATACAA GCCTAACNNNGATCGACATG | 4216 |
| TGCAGGACCAGAGAATTCGAATACAG GTCCTGGNNNGATCGACATG | 3737 | TGCAGGACCAGAGAATTCGAATACAT TTCGGTCNNNGATCGACATG | 3977 | TGCAGGACCAGAGAATTCGAATACAC GAGGAATNNNGATCGACATG | 4217 |
| TGCAGGACCAGAGAATTCGAATACAC TGTACAGNNNGATCGACATG | 3738 | TGCAGGACCAGAGAATTCGAATACAT TAGGTTANNNGATCGACATG | 3978 | TGCAGGACCAGAGAATTCGAATACAC CCGAGCANNNGATCGACATG | 4218 |
| TGCAGGACCAGAGAATTCGAATACAG ATAAGTTNNNGATCGACATG | 3739 | TGCAGGACCAGAGAATTCGAATACAA ACGCGTTNNNGATCGACATG | 3979 | TGCAGGACCAGAGAATTCGAATACAT ACAATACNNNGATCGACATG | 4219 |

FIG. 17E

| Pool-16 | SEQ ID NO: | Pool-17 | SEQ ID NO: | Pool-18 | SEQ ID NO: |
|---|---|---|---|---|---|
| TGCAGGACCAGAGAATTCGAATACAAAATCCTANNNGATCGACATG | 3740 | TGCAGGACCAGAGAATTCGAATACAAGGTAAGCNNNGATCGACATG | 3980 | TGCAGGACCAGAGAATTCGAATACATAACATGTNNNGATCGACATG | 4220 |
| TGCAGGACCAGAGAATTCGAATACACATCATGGNNNGATCGACATG | 3741 | TGCAGGACCAGAGAATTCGAATACAAATTGACTNNNGATCGACATG | 3981 | TGCAGGACCAGAGAATTCGAATACAGTTGCGGCNNNGATCGACATG | 4221 |
| TGCAGGACCAGAGAATTCGAATACATTCACTGCNNNGATCGACATG | 3742 | TGCAGGACCAGAGAATTCGAATACAAACTGTANNNGATCGACATG | 3982 | TGCAGGACCAGAGAATTCGAATACATTCTGCAGNNNGATCGACATG | 4222 |
| TGCAGGACCAGAGAATTCGAATACATTGCCGCCNNNGATCGACATG | 3743 | TGCAGGACCAGAGAATTCGAATACATTCTCTGGNNNGATCGACATG | 3983 | TGCAGGACCAGAGAATTCGAATACAGGTTAGTCNNNGATCGACATG | 4223 |
| TGCAGGACCAGAGAATTCGAATACATGTCCTGTNNNGATCGACATG | 3744 | TGCAGGACCAGAGAATTCGAATACAAGAAGAAANNNGATCGACATG | 3984 | TGCAGGACCAGAGAATTCGAATACACTTAAGATNNNGATCGACATG | 4224 |
| TGCAGGACCAGAGAATTCGAATACAGGCGGTCTNNNGATCGACATG | 3745 | TGCAGGACCAGAGAATTCGAATACAAAATGAACNNNGATCGACATG | 3985 | TGCAGGACCAGAGAATTCGAATACACTCCTACANNNGATCGACATG | 4225 |
| TGCAGGACCAGAGAATTCGAATACAACCCACGGNNNGATCGACATG | 3746 | TGCAGGACCAGAGAATTCGAATACAAACACACCNNNGATCGACATG | 3986 | TGCAGGACCAGAGAATTCGAATACAGCTCAGTANNNGATCGACATG | 4226 |
| TGCAGGACCAGAGAATTCGAATACATCCTTTAANNNGATCGACATG | 3747 | TGCAGGACCAGAGAATTCGAATACATAAATGCTNNNGATCGACATG | 3987 | TGCAGGACCAGAGAATTCGAATACAGGTACTACNNNGATCGACATG | 4227 |
| TGCAGGACCAGAGAATTCGAATACATTACAAGTNNNGATCGACATG | 3748 | TGCAGGACCAGAGAATTCGAATACAACCCGTTANNNGATCGACATG | 3988 | TGCAGGACCAGAGAATTCGAATACATAGTATGTNNNGATCGACATG | 4228 |
| TGCAGGACCAGAGAATTCGAATACATCGAGGAANNNGATCGACATG | 3749 | TGCAGGACCAGAGAATTCGAATACACCGGCGTANNNGATCGACATG | 3989 | TGCAGGACCAGAGAATTCGAATACAAAGCATCCNNNGATCGACATG | 4229 |
| TGCAGGACCAGAGAATTCGAATACAGACACTCANNNGATCGACATG | 3750 | TGCAGGACCAGAGAATTCGAATACACGTAGACTNNNGATCGACATG | 3990 | TGCAGGACCAGAGAATTCGAATACAACTAAAAGNNNGATCGACATG | 4230 |
| TGCAGGACCAGAGAATTCGAATACAACTCTAGGNNNGATCGACATG | 3751 | TGCAGGACCAGAGAATTCGAATACAGGAAGTCANNNGATCGACATG | 3991 | TGCAGGACCAGAGAATTCGAATACAACTTTAAGNNNGATCGACATG | 4231 |
| TGCAGGACCAGAGAATTCGAATACATCTTACTNNNGATCGACATG | 3752 | TGCAGGACCAGAGAATTCGAATACAAGAATTGANNNGATCGACATG | 3992 | TGCAGGACCAGAGAATTCGAATACAACGAATAANNNGATCGACATG | 4232 |
| TGCAGGACCAGAGAATTCGAATACAAAGAGAANNNGATCGACATG | 3753 | TGCAGGACCAGAGAATTCGAATACAACCCCTTANNNGATCGACATG | 3993 | TGCAGGACCAGAGAATTCGAATACATAGCGTCANNNGATCGACATG | 4233 |
| TGCAGGACCAGAGAATTCGAATACAACAGCAGANNNGATCGACATG | 3754 | TGCAGGACCAGAGAATTCGAATACATACAGACCNNNGATCGACATG | 3994 | TGCAGGACCAGAGAATTCGAATACAATCATCCCNNNGATCGACATG | 4234 |
| TGCAGGACCAGAGAATTCGAATACATGAGTACCNNNGATCGACATG | 3755 | TGCAGGACCAGAGAATTCGAATACAATTAGACTNNNGATCGACATG | 3995 | TGCAGGACCAGAGAATTCGAATACAAAACAACNNNGATCGACATG | 4235 |
| TGCAGGACCAGAGAATTCGAATACAGACTGTCANNNGATCGACATG | 3756 | TGCAGGACCAGAGAATTCGAATACAAACTAGACNNNGATCGACATG | 3996 | TGCAGGACCAGAGAATTCGAATACACTATCAGGNNNGATCGACATG | 4236 |
| TGCAGGACCAGAGAATTCGAATACATCGAGGCCNNNGATCGACATG | 3757 | TGCAGGACCAGAGAATTCGAATACAGCCCTAAANNNGATCGACATG | 3997 | TGCAGGACCAGAGAATTCGAATACATACTGTCCNNNGATCGACATG | 4237 |
| TGCAGGACCAGAGAATTCGAATACAGTCCATANNNGATCGACATG | 3758 | TGCAGGACCAGAGAATTCGAATACAAGAGTGGTNNNGATCGACATG | 3998 | TGCAGGACCAGAGAATTCGAATACAAGGACACANNNGATCGACATG | 4238 |
| TGCAGGACCAGAGAATTCGAATACAGACTGTTGNNNGATCGACATG | 3759 | TGCAGGACCAGAGAATTCGAATACAATCTGAATNNNGATCGACATG | 3999 | TGCAGGACCAGAGAATTCGAATACACTGACGTNNNGATCGACATG | 4239 |
| TGCAGGACCAGAGAATTCGAATACAACACACTGNNNGATCGACATG | 3760 | TGCAGGACCAGAGAATTCGAATACAAGCATCACNNNGATCGACATG | 4000 | TGCAGGACCAGAGAATTCGAATACACTTGTACCNNNGATCGACATG | 4240 |
| TGCAGGACCAGAGAATTCGAATACAAGGTGACANNNGATCGACATG | 3761 | TGCAGGACCAGAGAATTCGAATACAAATTGGAANNNGATCGACATG | 4001 | TGCAGGACCAGAGAATTCGAATACAGGATGCGGNNNGATCGACATG | 4241 |
| TGCAGGACCAGAGAATTCGAATACAAACAATGNNNGATCGACATG | 3762 | TGCAGGACCAGAGAATTCGAATACACTAGCCCCNNNGATCGACATG | 4002 | TGCAGGACCAGAGAATTCGAATACACTGATTGGNNNGATCGACATG | 4242 |
| TGCAGGACCAGAGAATTCGAATACAGATTTGTANNNGATCGACATG | 3763 | TGCAGGACCAGAGAATTCGAATACATCTTGCTGNNNGATCGACATG | 4003 | TGCAGGACCAGAGAATTCGAATACAGCAACTCANNNGATCGACATG | 4243 |
| TGCAGGACCAGAGAATTCGAATACACCCCCGATNNNGATCGACATG | 3764 | TGCAGGACCAGAGAATTCGAATACACCGTCCTGNNNGATCGACATG | 4004 | TGCAGGACCAGAGAATTCGAATACATACCTCACNNNGATCGACATG | 4244 |
| TGCAGGACCAGAGAATTCGAATACAAGGAGCGCNNNGATCGACATG | 3765 | TGCAGGACCAGAGAATTCGAATACACCTAACGANNNGATCGACATG | 4005 | TGCAGGACCAGAGAATTCGAATACATGCACCCCNNNGATCGACATG | 4245 |
| TGCAGGACCAGAGAATTCGAATACACCCTGGAGNNNGATCGACATG | 3766 | TGCAGGACCAGAGAATTCGAATACAAAAATAGCNNNGATCGACATG | 4006 | TGCAGGACCAGAGAATTCGAATACAGTTCCTACNNNGATCGACATG | 4246 |
| TGCAGGACCAGAGAATTCGAATACACGCACTCCNNNGATCGACATG | 3767 | TGCAGGACCAGAGAATTCGAATACAAAGCACTCNNNGATCGACATG | 4007 | TGCAGGACCAGAGAATTCGAATACATACTGTTTNNNGATCGACATG | 4247 |
| TGCAGGACCAGAGAATTCGAATACAGAAGTCAGNNNGATCGACATG | 3768 | TGCAGGACCAGAGAATTCGAATACAGTTCAACGNNNGATCGACATG | 4008 | TGCAGGACCAGAGAATTCGAATACACTTCATATNNNGATCGACATG | 4248 |
| TGCAGGACCAGAGAATTCGAATACAGGCGTCGTNNNGATCGACATG | 3769 | TGCAGGACCAGAGAATTCGAATACACGTCTGTTNNNGATCGACATG | 4009 | TGCAGGACCAGAGAATTCGAATACATCTGCTGTNNNGATCGACATG | 4249 |
| TGCAGGACCAGAGAATTCGAATACACATTGTCNNNGATCGACATG | 3770 | TGCAGGACCAGAGAATTCGAATACAGCACGGCTNNNGATCGACATG | 4010 | TGCAGGACCAGAGAATTCGAATACATGGTATTANNNGATCGACATG | 4250 |
| TGCAGGACCAGAGAATTCGAATACATAGTAACTNNNGATCGACATG | 3771 | TGCAGGACCAGAGAATTCGAATACAACCCAAACNNNGATCGACATG | 4011 | TGCAGGACCAGAGAATTCGAATACAAGAATGTANNNGATCGACATG | 4251 |
| TGCAGGACCAGAGAATTCGAATACATAGATGTTNNNGATCGACATG | 3772 | TGCAGGACCAGAGAATTCGAATACACATAAACTNNNGATCGACATG | 4012 | TGCAGGACCAGAGAATTCGAATACAGGCGAGCANNNGATCGACATG | 4252 |

FIG. 17F

| Pool-16 | SEQ ID NO: | Pool-17 | SEQ ID NO: | Pool-18 | SEQ ID NO: |
|---|---|---|---|---|---|
| TGCAGGACCAGAGAATTCGAATACAAATGAGCGNNNGATCGACATG | 3773 | TGCAGGACCAGAGAATTCGAATACATCCGTAAGCNNNGATCGACATG | 4013 | TGCAGGACCAGAGAATTCGAATACAGCCACAATNNNGATCGACATG | 4253 |
| TGCAGGACCAGAGAATTCGAATACAACTTGCGANNNGATCGACATG | 3774 | TGCAGGACCAGAGAATTCGAATACAGAGCTTGTNNNGATCGACATG | 4014 | TGCAGGACCAGAGAATTCGAATACATATTCTCANNNGATCGACATG | 4254 |
| TGCAGGACCAGAGAATTCGAATACAGGCGTACCNNNGATCGACATG | 3775 | TGCAGGACCAGAGAATTCGAATACATTTTTGTTNNNGATCGACATG | 4015 | TGCAGGACCAGAGAATTCGAATACAAAGACCTCNNNGATCGACATG | 4255 |
| TGCAGGACCAGAGAATTCGAATACAGGTCACATNNNGATCGACATG | 3776 | TGCAGGACCAGAGAATTCGAATACATGAGTAGGNNNGATCGACATG | 4016 | TGCAGGACCAGAGAATTCGAATACACACATAATNNNGATCGACATG | 4256 |
| TGCAGGACCAGAGAATTCGAATACACACTTAAANNNGATCGACATG | 3777 | TGCAGGACCAGAGAATTCGAATACATGAGTCTGNNNGATCGACATG | 4017 | TGCAGGACCAGAGAATTCGAATACAACCCTGAANNNGATCGACATG | 4257 |
| TGCAGGACCAGAGAATTCGAATACATTTACCTANNNGATCGACATG | 3778 | TGCAGGACCAGAGAATTCGAATACAAGAAGCTGNNNGATCGACATG | 4018 | TGCAGGACCAGAGAATTCGAATACAGTAGACCTNNNGATCGACATG | 4258 |
| TGCAGGACCAGAGAATTCGAATACAAGTTTGGCNNNGATCGACATG | 3779 | TGCAGGACCAGAGAATTCGAATACATAGAAGCGNNNGATCGACATG | 4019 | TGCAGGACCAGAGAATTCGAATACACCCTACCGNNNGATCGACATG | 4259 |
| TGCAGGACCAGAGAATTCGAATACAGAGACATGNNNGATCGACATG | 3780 | TGCAGGACCAGAGAATTCGAATACAGCTTATGNNNGATCGACATG | 4020 | TGCAGGACCAGAGAATTCGAATACATATCCCACNNNGATCGACATG | 4260 |
| TGCAGGACCAGAGAATTCGAATACAGAGGCATANNNGATCGACATG | 3781 | TGCAGGACCAGAGAATTCGAATACAGGCATATCNNNGATCGACATG | 4021 | TGCAGGACCAGAGAATTCGAATACAAGTCATTANNNGATCGACATG | 4261 |
| TGCAGGACCAGAGAATTCGAATACACCTGCTCGNNNGATCGACATG | 3782 | TGCAGGACCAGAGAATTCGAATACATCCGCTTANNNGATCGACATG | 4022 | TGCAGGACCAGAGAATTCGAATACAGGAACAACNNNGATCGACATG | 4262 |
| TGCAGGACCAGAGAATTCGAATACATTGCTAGGNNNGATCGACATG | 3783 | TGCAGGACCAGAGAATTCGAATACATTTATAGGNNNGATCGACATG | 4023 | TGCAGGACCAGAGAATTCGAATACAATCTCTGCNNNGATCGACATG | 4263 |
| TGCAGGACCAGAGAATTCGAATACATCCCGACNNNGATCGACATG | 3784 | TGCAGGACCAGAGAATTCGAATACAATGCTTAANNNGATCGACATG | 4024 | TGCAGGACCAGAGAATTCGAATACACTGTACCTNNNGATCGACATG | 4264 |
| TGCAGGACCAGAGAATTCGAATACACACGAATCNNNGATCGACATG | 3785 | TGCAGGACCAGAGAATTCGAATACATGACGTACNNNGATCGACATG | 4025 | TGCAGGACCAGAGAATTCGAATACAGATCCAGTNNNGATCGACATG | 4265 |
| TGCAGGACCAGAGAATTCGAATACAGCGTCGCANNNGATCGACATG | 3786 | TGCAGGACCAGAGAATTCGAATACAAGAGAAANNNGATCGACATG | 4026 | TGCAGGACCAGAGAATTCGAATACATAAGTTCANNNGATCGACATG | 4266 |
| TGCAGGACCAGAGAATTCGAATACAAATCCAATNNNGATCGACATG | 3787 | TGCAGGACCAGAGAATTCGAATACATGTCTCGTNNNGATCGACATG | 4027 | TGCAGGACCAGAGAATTCGAATACACCGTTAGANNNGATCGACATG | 4267 |
| TGCAGGACCAGAGAATTCGAATACACGCGAACCNNNGATCGACATG | 3788 | TGCAGGACCAGAGAATTCGAATACACGTTATGGNNNGATCGACATG | 4028 | TGCAGGACCAGAGAATTCGAATACAAAGAGACCNNNGATCGACATG | 4268 |
| TGCAGGACCAGAGAATTCGAATACATATGATCANNNTGCATCAGGT | 3789 | TGCAGGACCAGAGAATTCGAATACATATTGAGTNNNTGCATCAGGT | 4029 | TGCAGGACCAGAGAATTCGAATACACGCCCTACNNNTGCATCAGGT | 4269 |
| TGCAGGACCAGAGAATTCGAATACATTGGCACANNNTGCATCAGGT | 3790 | TGCAGGACCAGAGAATTCGAATACAAATAGAGTNNNTGCATCAGGT | 4030 | TGCAGGACCAGAGAATTCGAATACAGACGGCCTNNNTGCATCAGGT | 4270 |
| TGCAGGACCAGAGAATTCGAATACACTACACCTNNNTGCATCAGGT | 3791 | TGCAGGACCAGAGAATTCGAATACACAGACATCNNNTGCATCAGGT | 4031 | TGCAGGACCAGAGAATTCGAATACACGCGGAGANNNTGCATCAGGT | 4271 |
| TGCAGGACCAGAGAATTCGAATACATTAGAGTTNNNTGCATCAGGT | 3792 | TGCAGGACCAGAGAATTCGAATACAGAAGCCAANNNTGCATCAGGT | 4032 | TGCAGGACCAGAGAATTCGAATACAGCGATAAGNNNTGCATCAGGT | 4272 |
| TGCAGGACCAGAGAATTCGAATACAGGTGTTGTNNNTGCATCAGGT | 3793 | TGCAGGACCAGAGAATTCGAATACACAGTCCANNNTGCATCAGGT | 4033 | TGCAGGACCAGAGAATTCGAATACAACGCTAGTNNNTGCATCAGGT | 4273 |
| TGCAGGACCAGAGAATTCGAATACACCAGACGCNNNTGCATCAGGT | 3794 | TGCAGGACCAGAGAATTCGAATACATTCCGACTNNNTGCATCAGGT | 4034 | TGCAGGACCAGAGAATTCGAATACATTTGAATGNNNTGCATCAGGT | 4274 |
| TGCAGGACCAGAGAATTCGAATACATGTTGGCANNNTGCATCAGGT | 3795 | TGCAGGACCAGAGAATTCGAATACAACAGTATTNNNTGCATCAGGT | 4035 | TGCAGGACCAGAGAATTCGAATACATATTAAATNNNTGCATCAGGT | 4275 |
| TGCAGGACCAGAGAATTCGAATACATCTTCCTCNNNTGCATCAGGT | 3796 | TGCAGGACCAGAGAATTCGAATACAGAGAATATNNNTGCATCAGGT | 4036 | TGCAGGACCAGAGAATTCGAATACACGTGTTGANNNTGCATCAGGT | 4276 |
| TGCAGGACCAGAGAATTCGAATACACAAGATAANNNTGCATCAGGT | 3797 | TGCAGGACCAGAGAATTCGAATACAAGTAAGGCNNNTGCATCAGGT | 4037 | TGCAGGACCAGAGAATTCGAATACAAAGCTTATNNNTGCATCAGGT | 4277 |
| TGCAGGACCAGAGAATTCGAATACATACTAGCGNNNTGCATCAGGT | 3798 | TGCAGGACCAGAGAATTCGAATACAAGCGTATCNNNTGCATCAGGT | 4038 | TGCAGGACCAGAGAATTCGAATACACCCCGACTNNNTGCATCAGGT | 4278 |
| TGCAGGACCAGAGAATTCGAATACAGACACAAGNNNTGCATCAGGT | 3799 | TGCAGGACCAGAGAATTCGAATACATACGGTTGNNNTGCATCAGGT | 4039 | TGCAGGACCAGAGAATTCGAATACAGTCGTCAANNNTGCATCAGGT | 4279 |
| TGCAGGACCAGAGAATTCGAATACAGTTACCTCNNNTGCATCAGGT | 3800 | TGCAGGACCAGAGAATTCGAATACAAACGAAGGNNNTGCATCAGGT | 4040 | TGCAGGACCAGAGAATTCGAATACATACATCCGNNNTGCATCAGGT | 4280 |
| TGCAGGACCAGAGAATTCGAATACATCTACCACNNNTGCATCAGGT | 3801 | TGCAGGACCAGAGAATTCGAATACACATTGGACNNNTGCATCAGGT | 4041 | TGCAGGACCAGAGAATTCGAATACAGACTTTCNNNTGCATCAGGT | 4281 |
| TGCAGGACCAGAGAATTCGAATACATAGTCGTGNNNTGCATCAGGT | 3802 | TGCAGGACCAGAGAATTCGAATACATAAGGCTCNNNTGCATCAGGT | 4042 | TGCAGGACCAGAGAATTCGAATACATGCCCTATNNNTGCATCAGGT | 4282 |
| TGCAGGACCAGAGAATTCGAATACAAATGCAGGNNNTGCATCAGGT | 3803 | TGCAGGACCAGAGAATTCGAATACACGAAGCGGNNNTGCATCAGGT | 4043 | TGCAGGACCAGAGAATTCGAATACATGACGGAANNNTGCATCAGGT | 4283 |
| TGCAGGACCAGAGAATTCGAATACACATGGACTNNNTGCATCAGGT | 3804 | TGCAGGACCAGAGAATTCGAATACAGACGATTCNNNTGCATCAGGT | 4044 | TGCAGGACCAGAGAATTCGAATACAGCTGCCAGNNNTGCATCAGGT | 4284 |
| TGCAGGACCAGAGAATTCGAATACATTGCGAGTNNNTGCATCAGGT | 3805 | TGCAGGACCAGAGAATTCGAATACAGTCGATACNNNTGCATCAGGT | 4045 | TGCAGGACCAGAGAATTCGAATACATCATATAGNNNTGCATCAGGT | 4285 |

FIG. 17G

| Pool-16 | SEQ ID NO: | Pool-17 | SEQ ID NO: | Pool-18 | SEQ ID NO: |
|---|---|---|---|---|---|
| TGCAGGACCAGAGAATTCGAATACAT TGCAAGCNNNTGCATCAGGT | 3806 | TGCAGGACCAGAGAATTCGAATACAC ATCAATANNNTGCATCAGGT | 4046 | TGCAGGACCAGAGAATTCGAATACAT GTGCGATNNNTGCATCAGGT | 4286 |
| TGCAGGACCAGAGAATTCGAATACAC CTCGGAGNNNTGCATCAGGT | 3807 | TGCAGGACCAGAGAATTCGAATACAC ACACATGNNNTGCATCAGGT | 4047 | TGCAGGACCAGAGAATTCGAATACAC ACGATCANNNTGCATCAGGT | 4287 |
| TGCAGGACCAGAGAATTCGAATACAT AACATTGNNNTGCATCAGGT | 3808 | TGCAGGACCAGAGAATTCGAATACAC CAGCGAGNNNTGCATCAGGT | 4048 | TGCAGGACCAGAGAATTCGAATACAG ACTGCCGNNNTGCATCAGGT | 4288 |
| TGCAGGACCAGAGAATTCGAATACAG AGGTTAGNNNTGCATCAGGT | 3809 | TGCAGGACCAGAGAATTCGAATACAT ACGGCTANNNTGCATCAGGT | 4049 | TGCAGGACCAGAGAATTCGAATACAC TGGTCATNNNTGCATCAGGT | 4289 |
| TGCAGGACCAGAGAATTCGAATACAA GAAACTANNNTGCATCAGGT | 3810 | TGCAGGACCAGAGAATTCGAATACAC AGCAGAANNNTGCATCAGGT | 4050 | TGCAGGACCAGAGAATTCGAATACAT GTGAGCTNNNTGCATCAGGT | 4290 |
| TGCAGGACCAGAGAATTCGAATACAT CCACCTANNNTGCATCAGGT | 3811 | TGCAGGACCAGAGAATTCGAATACAA AGATTAGNNNTGCATCAGGT | 4051 | TGCAGGACCAGAGAATTCGAATACAA ACCGTCANNNTGCATCAGGT | 4291 |
| TGCAGGACCAGAGAATTCGAATACAT CCTTCCTNNNTGCATCAGGT | 3812 | TGCAGGACCAGAGAATTCGAATACAC CAAAGACNNNTGCATCAGGT | 4052 | TGCAGGACCAGAGAATTCGAATACAA TTACAGTNNNTGCATCAGGT | 4292 |
| TGCAGGACCAGAGAATTCGAATACAA ACTCCGANNNTGCATCAGGT | 3813 | TGCAGGACCAGAGAATTCGAATACAA TAAACAGNNNTGCATCAGGT | 4053 | TGCAGGACCAGAGAATTCGAATACAG CAATAAANNNTGCATCAGGT | 4293 |
| TGCAGGACCAGAGAATTCGAATACAA ATTAGCTNNNTGCATCAGGT | 3814 | TGCAGGACCAGAGAATTCGAATACAT TCCAAAANNNTGCATCAGGT | 4054 | TGCAGGACCAGAGAATTCGAATACAA GCTTAGCNNNTGCATCAGGT | 4294 |
| TGCAGGACCAGAGAATTCGAATACAA TAGTAAGNNNTGCATCAGGT | 3815 | TGCAGGACCAGAGAATTCGAATACAT GGTATCGNNNTGCATCAGGT | 4055 | TGCAGGACCAGAGAATTCGAATACAT CATTGCCNNNTGCATCAGGT | 4295 |
| TGCAGGACCAGAGAATTCGAATACAG TTTTACTNNNTGCATCAGGT | 3816 | TGCAGGACCAGAGAATTCGAATACAA ACACTTANNNTGCATCAGGT | 4056 | TGCAGGACCAGAGAATTCGAATACAC ACTATAANNNTGCATCAGGT | 4296 |
| TGCAGGACCAGAGAATTCGAATACAC GCAATTGNNNTGCATCAGGT | 3817 | TGCAGGACCAGAGAATTCGAATACAA CCGTGGCNNNTGCATCAGGT | 4057 | TGCAGGACCAGAGAATTCGAATACAC TGCGTCCNNNTGCATCAGGT | 4297 |
| TGCAGGACCAGAGAATTCGAATACAC GAGGCGTNNNTGCATCAGGT | 3818 | TGCAGGACCAGAGAATTCGAATACAA GTCTAGCNNNTGCATCAGGT | 4058 | TGCAGGACCAGAGAATTCGAATACAC GATGACANNNTGCATCAGGT | 4298 |
| TGCAGGACCAGAGAATTCGAATACAG TAACTGCNNNTGCATCAGGT | 3819 | TGCAGGACCAGAGAATTCGAATACAA GACTCCANNNTGCATCAGGT | 4059 | TGCAGGACCAGAGAATTCGAATACAT AGAAGGCNNNTGCATCAGGT | 4299 |
| TGCAGGACCAGAGAATTCGAATACAT GTCAACGNNNTGCATCAGGT | 3820 | TGCAGGACCAGAGAATTCGAATACAC CAGGATTNNNTGCATCAGGT | 4060 | TGCAGGACCAGAGAATTCGAATACAA TACACCGNNNTGCATCAGGT | 4300 |
| TGCAGGACCAGAGAATTCGAATACAC GATTTTTNNNTGCATCAGGT | 3821 | TGCAGGACCAGAGAATTCGAATACAA GAATGATNNNTGCATCAGGT | 4061 | TGCAGGACCAGAGAATTCGAATACAT CCAGCAANNNTGCATCAGGT | 4301 |
| TGCAGGACCAGAGAATTCGAATACAC CGTATTCNNNTGCATCAGGT | 3822 | TGCAGGACCAGAGAATTCGAATACAA CGACATCNNNTGCATCAGGT | 4062 | TGCAGGACCAGAGAATTCGAATACAG TGTTCCTNNNTGCATCAGGT | 4302 |
| TGCAGGACCAGAGAATTCGAATACAG CCGCGATNNNTGCATCAGGT | 3823 | TGCAGGACCAGAGAATTCGAATACAG TAAAAACNNNTGCATCAGGT | 4063 | TGCAGGACCAGAGAATTCGAATACAG AAACGTGNNNTGCATCAGGT | 4303 |
| TGCAGGACCAGAGAATTCGAATACAG GCCCTAGNNNTGCATCAGGT | 3824 | TGCAGGACCAGAGAATTCGAATACAA TTAACACNNNTGCATCAGGT | 4064 | TGCAGGACCAGAGAATTCGAATACAC CCTCTAANNNTGCATCAGGT | 4304 |
| TGCAGGACCAGAGAATTCGAATACAA ACAGGCANNNTGCATCAGGT | 3825 | TGCAGGACCAGAGAATTCGAATACAA CAAATTCNNNTGCATCAGGT | 4065 | TGCAGGACCAGAGAATTCGAATACAA CCGAGCCNNNTGCATCAGGT | 4305 |
| TGCAGGACCAGAGAATTCGAATACAA CCTATGGNNNTGCATCAGGT | 3826 | TGCAGGACCAGAGAATTCGAATACAC GTCCATTNNNTGCATCAGGT | 4066 | TGCAGGACCAGAGAATTCGAATACAG CGCCCTTNNNTGCATCAGGT | 4306 |
| TGCAGGACCAGAGAATTCGAATACAT GTGTCGANNNTGCATCAGGT | 3827 | TGCAGGACCAGAGAATTCGAATACAA GAAATCANNNTGCATCAGGT | 4067 | TGCAGGACCAGAGAATTCGAATACAA AATAGACNNNTGCATCAGGT | 4307 |
| TGCAGGACCAGAGAATTCGAATACAG TGGATTCNNNTGCATCAGGT | 3828 | TGCAGGACCAGAGAATTCGAATACAA AATCACTNNNTGCATCAGGT | 4068 | TGCAGGACCAGAGAATTCGAATACAT GACACTGNNNTGCATCAGGT | 4308 |
| TGCAGGACCAGAGAATTCGAATACAT CGGACCGNNNTGCATCAGGT | 3829 | TGCAGGACCAGAGAATTCGAATACAC TCCACGCNNNTGCATCAGGT | 4069 | TGCAGGACCAGAGAATTCGAATACAG GCGCGAGNNNTGCATCAGGT | 4309 |
| TGCAGGACCAGAGAATTCGAATACAA AACATAGNNNTGCATCAGGT | 3830 | TGCAGGACCAGAGAATTCGAATACAG AATAATGNNNTGCATCAGGT | 4070 | TGCAGGACCAGAGAATTCGAATACAG CAGAAGTNNNTGCATCAGGT | 4310 |
| TGCAGGACCAGAGAATTCGAATACAA GAAGCGTNNNTGCATCAGGT | 3831 | TGCAGGACCAGAGAATTCGAATACAT GTGACCANNNTGCATCAGGT | 4071 | TGCAGGACCAGAGAATTCGAATACAG GCTGATTNNNTGCATCAGGT | 4311 |
| TGCAGGACCAGAGAATTCGAATACAC CCTCACGNNNTGCATCAGGT | 3832 | TGCAGGACCAGAGAATTCGAATACAT CGATTAANNNTGCATCAGGT | 4072 | TGCAGGACCAGAGAATTCGAATACAG TAGAATANNNTGCATCAGGT | 4312 |
| TGCAGGACCAGAGAATTCGAATACAA ACTGTCGNNNTGCATCAGGT | 3833 | TGCAGGACCAGAGAATTCGAATACAC GCCAAATNNNTGCATCAGGT | 4073 | TGCAGGACCAGAGAATTCGAATACAC CATCGAANNNTGCATCAGGT | 4313 |
| TGCAGGACCAGAGAATTCGAATACAT CTTGGAGNNNTGCATCAGGT | 3834 | TGCAGGACCAGAGAATTCGAATACAC TTGTAAANNNTGCATCAGGT | 4074 | TGCAGGACCAGAGAATTCGAATACAT TGCCTACNNNTGCATCAGGT | 4314 |
| TGCAGGACCAGAGAATTCGAATACAG TGAAATANNNTGCATCAGGT | 3835 | TGCAGGACCAGAGAATTCGAATACAA ATTAGAGNNNTGCATCAGGT | 4075 | TGCAGGACCAGAGAATTCGAATACAA CTCCCATNNNTGCATCAGGT | 4315 |
| TGCAGGACCAGAGAATTCGAATACAT GCTTCTGNNNTGCATCAGGT | 3836 | TGCAGGACCAGAGAATTCGAATACAT AGCTTGGNNNTGCATCAGGT | 4076 | TGCAGGACCAGAGAATTCGAATACAA TTTCCACNNNTGCATCAGGT | 4316 |
| TGCAGGACCAGAGAATTCGAATACAT GACTTCCNNNTGCATCAGGT | 3837 | TGCAGGACCAGAGAATTCGAATACAA TAGGAGCNNNTGCATCAGGT | 4077 | TGCAGGACCAGAGAATTCGAATACAG ATATTGTNNNTGCATCAGGT | 4317 |
| TGCAGGACCAGAGAATTCGAATACAC CCGGATGNNNTGCATCAGGT | 3838 | TGCAGGACCAGAGAATTCGAATACAT TATACTCNNNTGCATCAGGT | 4078 | TGCAGGACCAGAGAATTCGAATACAA CTGAGGANNNTGCATCAGGT | 4318 |

FIG. 17H

| Pool-16 | SEQ ID NO: | Pool-17 | SEQ ID NO: | Pool-18 | SEQ ID NO: |
|---|---|---|---|---|---|
| TGCAGGACCAGAGAATTCGAATACAGAGGACATNNNTGCATCAGGT | 3839 | TGCAGGACCAGAGAATTCGAATACATTGTTGCCNNNTGCATCAGGT | 4079 | TGCAGGACCAGAGAATTCGAATACAGTAGTCTGNNNTGCATCAGGT | 4319 |
| TGCAGGACCAGAGAATTCGAATACACAGGTATCNNNTGCATCAGGT | 3840 | TGCAGGACCAGAGAATTCGAATACATTCCGAGANNNTGCATCAGGT | 4080 | TGCAGGACCAGAGAATTCGAATACATGTAAATCNNNTGCATCAGGT | 4320 |
| TGCAGGACCAGAGAATTCGAATACAGTAGTATTNNNTGCATCAGGT | 3841 | TGCAGGACCAGAGAATTCGAATACAATCCCATCNNNTGCATCAGGT | 4081 | TGCAGGACCAGAGAATTCGAATACAGCATATGCNNNTGCATCAGGT | 4321 |
| TGCAGGACCAGAGAATTCGAATACAAAGGAGGANNNTGCATCAGGT | 3842 | TGCAGGACCAGAGAATTCGAATACATTTGCCACNNNTGCATCAGGT | 4082 | TGCAGGACCAGAGAATTCGAATACAATTCGTAANNNTGCATCAGGT | 4322 |
| TGCAGGACCAGAGAATTCGAATACAAAGAGCCANNNTGCATCAGGT | 3843 | TGCAGGACCAGAGAATTCGAATACAGTGAGCGGNNNTGCATCAGGT | 4083 | TGCAGGACCAGAGAATTCGAATACAAATCCACGNNNTGCATCAGGT | 4323 |
| TGCAGGACCAGAGAATTCGAATACAGTCTCTCANNNTGCATCAGGT | 3844 | TGCAGGACCAGAGAATTCGAATACATCGCATCTNNNTGCATCAGGT | 4084 | TGCAGGACCAGAGAATTCGAATACAGCGCCGCGNNNTGCATCAGGT | 4324 |
| TGCAGGACCAGAGAATTCGAATACAACGGTGTTNNNTGCATCAGGT | 3845 | TGCAGGACCAGAGAATTCGAATACATCTGCAGNNNTGCATCAGGT | 4085 | TGCAGGACCAGAGAATTCGAATACAGGCTCTGACNNNTGCATCAGGT | 4325 |
| TGCAGGACCAGAGAATTCGAATACACGTACGATNNNTGCATCAGGT | 3846 | TGCAGGACCAGAGAATTCGAATACAGCCCAAGCNNNTGCATCAGGT | 4086 | TGCAGGACCAGAGAATTCGAATACAACCCCGAGNNNTGCATCAGGT | 4326 |
| TGCAGGACCAGAGAATTCGAATACAGAGGTGTANNNTGCATCAGGT | 3847 | TGCAGGACCAGAGAATTCGAATACATTTCTCGGNNNTGCATCAGGT | 4087 | TGCAGGACCAGAGAATTCGAATACAAGTCACCANNNTGCATCAGGT | 4327 |
| TGCAGGACCAGAGAATTCGAATACACACCACAANNNTGCATCAGGT | 3848 | TGCAGGACCAGAGAATTCGAATACAGGCCTACGNNNTGCATCAGGT | 4088 | TGCAGGACCAGAGAATTCGAATACAAAAATTCNNNTGCATCAGGT | 4328 |

FIG. 18A

| Pool-19 | SEQ ID NO: | Pool-20 | SEQ ID NO: | Pool-21 | SEQ ID NO: |
|---|---|---|---|---|---|
| TGCAGGACCAGAGAATTCGAATA CAGCCCTCTGNNNACGTATGCCA | 4329 | TGCAGGACCAGAGAATTCGAATA CATGTTGTCCNNNACGTATGCCA | 4569 | TGCAGGACCAGAGAATTCGAATA CATGAAACAANNNACGTATGCCA | 4809 |
| TGCAGGACCAGAGAATTCGAATA CAGCAAAGGTNNNACGTATGCCA | 4330 | TGCAGGACCAGAGAATTCGAATA CATAACCAGCNNNACGTATGCCA | 4570 | TGCAGGACCAGAGAATTCGAATA CACCCGTTGCNNNACGTATGCCA | 4810 |
| TGCAGGACCAGAGAATTCGAATA CATTTCTATGNNNACGTATGCCA | 4331 | TGCAGGACCAGAGAATTCGAATA CATGCCGCGANNNACGTATGCCA | 4571 | TGCAGGACCAGAGAATTCGAATA CAGCATTGGTNNNACGTATGCCA | 4811 |
| TGCAGGACCAGAGAATTCGAATA CACGTGCAATNNNACGTATGCCA | 4332 | TGCAGGACCAGAGAATTCGAATA CAATCGTCTCNNNACGTATGCCA | 4572 | TGCAGGACCAGAGAATTCGAATA CATAGGCCATNNNACGTATGCCA | 4812 |
| TGCAGGACCAGAGAATTCGAATA CAGTTTAGGCNNNACGTATGCCA | 4333 | TGCAGGACCAGAGAATTCGAATA CATCCGCACCNNNACGTATGCCA | 4573 | TGCAGGACCAGAGAATTCGAATA CAACTCCTCANNNACGTATGCCA | 4813 |
| TGCAGGACCAGAGAATTCGAATA CAAAAATGACNNNACGTATGCCA | 4334 | TGCAGGACCAGAGAATTCGAATA CATTACTGAANNNACGTATGCCA | 4574 | TGCAGGACCAGAGAATTCGAATA CACTAGGCGCNNNACGTATGCCA | 4814 |
| TGCAGGACCAGAGAATTCGAATA CACTACTAGGNNNACGTATGCCA | 4335 | TGCAGGACCAGAGAATTCGAATA CAAGGTCCGCNNNACGTATGCCA | 4575 | TGCAGGACCAGAGAATTCGAATA CAAGTTTAGTNNNACGTATGCCA | 4815 |
| TGCAGGACCAGAGAATTCGAATA CACACCCAGGNNNACGTATGCCA | 4336 | TGCAGGACCAGAGAATTCGAATA CAGTGCCCTCNNNACGTATGCCA | 4576 | TGCAGGACCAGAGAATTCGAATA CATTGATACANNNACGTATGCCA | 4816 |
| TGCAGGACCAGAGAATTCGAATA CAGCCGCCTTNNNACGTATGCCA | 4337 | TGCAGGACCAGAGAATTCGAATA CAGCGTAGCCNNNACGTATGCCA | 4577 | TGCAGGACCAGAGAATTCGAATA CAACAATTACNNNACGTATGCCA | 4817 |
| TGCAGGACCAGAGAATTCGAATA CACAACGTCANNNACGTATGCCA | 4338 | TGCAGGACCAGAGAATTCGAATA CATAGCCAACNNNACGTATGCCA | 4578 | TGCAGGACCAGAGAATTCGAATA CAATACCGGTNNNACGTATGCCA | 4818 |
| TGCAGGACCAGAGAATTCGAATA CATCTCAAGGNNNACGTATGCCA | 4339 | TGCAGGACCAGAGAATTCGAATA CAATATACCANNNACGTATGCCA | 4579 | TGCAGGACCAGAGAATTCGAATA CATGAAGCCTNNNACGTATGCCA | 4819 |
| TGCAGGACCAGAGAATTCGAATA CATCATAAACNNNACGTATGCCA | 4340 | TGCAGGACCAGAGAATTCGAATA CATAAAATCCNNNACGTATGCCA | 4580 | TGCAGGACCAGAGAATTCGAATA CATTACCTGCNNNACGTATGCCA | 4820 |
| TGCAGGACCAGAGAATTCGAATA CATCCTCCCCNNNACGTATGCCA | 4341 | TGCAGGACCAGAGAATTCGAATA CAGATGGTGANNNACGTATGCCA | 4581 | TGCAGGACCAGAGAATTCGAATA CATATCAGATNNNACGTATGCCA | 4821 |
| TGCAGGACCAGAGAATTCGAATA CAAGTAACCCNNNACGTATGCCA | 4342 | TGCAGGACCAGAGAATTCGAATA CAGAACGTAGNNNACGTATGCCA | 4582 | TGCAGGACCAGAGAATTCGAATA CAGAAGAATTNNNACGTATGCCA | 4822 |
| TGCAGGACCAGAGAATTCGAATA CAGTGACAAGNNNACGTATGCCA | 4343 | TGCAGGACCAGAGAATTCGAATA CAATATTAATNNNACGTATGCCA | 4583 | TGCAGGACCAGAGAATTCGAATA CAGATCACGTNNNACGTATGCCA | 4823 |
| TGCAGGACCAGAGAATTCGAATA CAGCAATACCNNNACGTATGCCA | 4344 | TGCAGGACCAGAGAATTCGAATA CATACTGAATNNNACGTATGCCA | 4584 | TGCAGGACCAGAGAATTCGAATA CAAGGTAGACNNNACGTATGCCA | 4824 |
| TGCAGGACCAGAGAATTCGAATA CAAATACGTTNNNACGTATGCCA | 4345 | TGCAGGACCAGAGAATTCGAATA CAGTCCGAGCNNNACGTATGCCA | 4585 | TGCAGGACCAGAGAATTCGAATA CATTGACCGANNNACGTATGCCA | 4825 |
| TGCAGGACCAGAGAATTCGAATA CACCATGTAGNNNACGTATGCCA | 4346 | TGCAGGACCAGAGAATTCGAATA CACCTGGTAANNNACGTATGCCA | 4586 | TGCAGGACCAGAGAATTCGAATA CACCACTGTTNNNACGTATGCCA | 4826 |
| TGCAGGACCAGAGAATTCGAATA CACCCAACGGNNNACGTATGCCA | 4347 | TGCAGGACCAGAGAATTCGAATA CACCCTAGAANNNACGTATGCCA | 4587 | TGCAGGACCAGAGAATTCGAATA CAGTCAGAAGNNNACGTATGCCA | 4827 |
| TGCAGGACCAGAGAATTCGAATA CAGCGCGTTGCNNNACGTATGCCA | 4348 | TGCAGGACCAGAGAATTCGAATA CATTAAAGTCNNNACGTATGCCA | 4588 | TGCAGGACCAGAGAATTCGAATA CACCGACCTCNNNACGTATGCCA | 4828 |
| TGCAGGACCAGAGAATTCGAATA CAGTGATCTGNNNACGTATGCCA | 4349 | TGCAGGACCAGAGAATTCGAATA CAACCTGTGCNNNACGTATGCCA | 4589 | TGCAGGACCAGAGAATTCGAATA CAATTAGTGTNNNACGTATGCCA | 4829 |
| TGCAGGACCAGAGAATTCGAATA CATAAGCCGTNNNACGTATGCCA | 4350 | TGCAGGACCAGAGAATTCGAATA CAGCTATCCTNNNACGTATGCCA | 4590 | TGCAGGACCAGAGAATTCGAATA CAGCATACCANNNACGTATGCCA | 4830 |
| TGCAGGACCAGAGAATTCGAATA CATGTTTGTTNNNACGTATGCCA | 4351 | TGCAGGACCAGAGAATTCGAATA CAAGCGTTGTNNNACGTATGCCA | 4591 | TGCAGGACCAGAGAATTCGAATA CAAGTTTTCTNNNACGTATGCCA | 4831 |
| TGCAGGACCAGAGAATTCGAATA CAACGAGCGGNNNACGTATGCCA | 4352 | TGCAGGACCAGAGAATTCGAATA CACTTCGCTANNNACGTATGCCA | 4592 | TGCAGGACCAGAGAATTCGAATA CATTCGCGTTNNNACGTATGCCA | 4832 |
| TGCAGGACCAGAGAATTCGAATA CATAGATCGCNNNACGTATGCCA | 4353 | TGCAGGACCAGAGAATTCGAATA CACATTTTGTNNNACGTATGCCA | 4593 | TGCAGGACCAGAGAATTCGAATA CATGGAGCCCNNNACGTATGCCA | 4833 |
| TGCAGGACCAGAGAATTCGAATA CATGATACGCNNNACGTATGCCA | 4354 | TGCAGGACCAGAGAATTCGAATA CAAACTTCGGNNNACGTATGCCA | 4594 | TGCAGGACCAGAGAATTCGAATA CACGTGGCACNNNACGTATGCCA | 4834 |
| TGCAGGACCAGAGAATTCGAATA CATAGTTACANNNACGTATGCCA | 4355 | TGCAGGACCAGAGAATTCGAATA CATACCGTGANNNACGTATGCCA | 4595 | TGCAGGACCAGAGAATTCGAATA CATCTTACTANNNACGTATGCCA | 4835 |
| TGCAGGACCAGAGAATTCGAATA CACTTGGTGANNNACGTATGCCA | 4356 | TGCAGGACCAGAGAATTCGAATA CAAGCTTTTTNNNACGTATGCCA | 4596 | TGCAGGACCAGAGAATTCGAATA CAATCCGGTANNNACGTATGCCA | 4836 |
| TGCAGGACCAGAGAATTCGAATA CATTAATCTCNNNACGTATGCCA | 4357 | TGCAGGACCAGAGAATTCGAATA CATGTTCTCGNNNACGTATGCCA | 4597 | TGCAGGACCAGAGAATTCGAATA CAGACACCTANNNACGTATGCCA | 4837 |
| TGCAGGACCAGAGAATTCGAATA CATTAGACCTNNNACGTATGCCA | 4358 | TGCAGGACCAGAGAATTCGAATA CAAATCGCGTNNNACGTATGCCA | 4598 | TGCAGGACCAGAGAATTCGAATA CATCCGTCTANNNACGTATGCCA | 4838 |
| TGCAGGACCAGAGAATTCGAATA CAACACCAGTNNNACGTATGCCA | 4359 | TGCAGGACCAGAGAATTCGAATA CATGAACCACNNNACGTATGCCA | 4599 | TGCAGGACCAGAGAATTCGAATA CAAGATTACTNNNACGTATGCCA | 4839 |
| TGCAGGACCAGAGAATTCGAATA CAACCAGGAANNNACGTATGCCA | 4360 | TGCAGGACCAGAGAATTCGAATA CAATTTCATNNNACGTATGCCA | 4600 | TGCAGGACCAGAGAATTCGAATA CAAGATTGAANNNACGTATGCCA | 4840 |
| TGCAGGACCAGAGAATTCGAATA CAATGCATGCNNNACGTATGCCA | 4361 | TGCAGGACCAGAGAATTCGAATA CACAGTCACANNNACGTATGCCA | 4601 | TGCAGGACCAGAGAATTCGAATA CATTTAAAGCNNNACGTATGCCA | 4841 |

FIG. 18B

| Pool-19 | SEQ ID NO: | Pool-20 | SEQ ID NO: | Pool-21 | SEQ ID NO: |
|---|---|---|---|---|---|
| TGCAGGACCAGAGAATTCGAATA CATACACATANNNACGTATGCCA | 4362 | TGCAGGACCAGAGAATTCGAATA CACCCATAGANNNACGTATGCCA | 4602 | TGCAGGACCAGAGAATTCGAATA CAGAATTGCCNNNACGTATGCCA | 4842 |
| TGCAGGACCAGAGAATTCGAATA CATCGTTCAANNNACGTATGCCA | 4363 | TGCAGGACCAGAGAATTCGAATA CACAGAATGCNNNACGTATGCCA | 4603 | TGCAGGACCAGAGAATTCGAATA CATTACGTCNNNACGTATGCCA | 4843 |
| TGCAGGACCAGAGAATTCGAATA CACTATCAAANNNACGTATGCCA | 4364 | TGCAGGACCAGAGAATTCGAATA CAGTATGAANNNACGTATGCCA | 4604 | TGCAGGACCAGAGAATTCGAATA CAATGAGGACNNNACGTATGCCA | 4844 |
| TGCAGGACCAGAGAATTCGAATA CATTACCAAANNNACGTATGCCA | 4365 | TGCAGGACCAGAGAATTCGAATA CAGTTTAAGTNNNACGTATGCCA | 4605 | TGCAGGACCAGAGAATTCGAATA CAATTGTTAGNNNACGTATGCCA | 4845 |
| TGCAGGACCAGAGAATTCGAATA CACCGGCGATNNNACGTATGCCA | 4366 | TGCAGGACCAGAGAATTCGAATA CAGCGTTATGNNNACGTATGCCA | 4606 | TGCAGGACCAGAGAATTCGAATA CAGCTTGTAGNNNACGTATGCCA | 4846 |
| TGCAGGACCAGAGAATTCGAATA CAGTTGTATANNNACGTATGCCA | 4367 | TGCAGGACCAGAGAATTCGAATA CATCCGTTACNNNACGTATGCCA | 4607 | TGCAGGACCAGAGAATTCGAATA CATTGTTCGNNNACGTATGCCA | 4847 |
| TGCAGGACCAGAGAATTCGAATA CAATACGGCTNNNACGTATGCCA | 4368 | TGCAGGACCAGAGAATTCGAATA CACGAAACCTNNNACGTATGCCA | 4608 | TGCAGGACCAGAGAATTCGAATA CAAAAGGCTNNNACGTATGCCA | 4848 |
| TGCAGGACCAGAGAATTCGAATA CATGGCAACTNNNACGTATGCCA | 4369 | TGCAGGACCAGAGAATTCGAATA CACGGCCATGNNNACGTATGCCA | 4609 | TGCAGGACCAGAGAATTCGAATA CACTTACGAGNNNACGTATGCCA | 4849 |
| TGCAGGACCAGAGAATTCGAATA CAGATTTCAANNNACGTATGCCA | 4370 | TGCAGGACCAGAGAATTCGAATA CACGAAAAGCNNNACGTATGCCA | 4610 | TGCAGGACCAGAGAATTCGAATA CAATCTATAGNNNACGTATGCCA | 4850 |
| TGCAGGACCAGAGAATTCGAATA CAGTATCTTTNNNACGTATGCCA | 4371 | TGCAGGACCAGAGAATTCGAATA CAAGGTTGTCNNNACGTATGCCA | 4611 | TGCAGGACCAGAGAATTCGAATA CAGGTACACTNNNACGTATGCCA | 4851 |
| TGCAGGACCAGAGAATTCGAATA CAGCAACAGANNNACGTATGCCA | 4372 | TGCAGGACCAGAGAATTCGAATA CAACGAAGGTNNNACGTATGCCA | 4612 | TGCAGGACCAGAGAATTCGAATA CACCGCCTCANNNACGTATGCCA | 4852 |
| TGCAGGACCAGAGAATTCGAATA CAGCGTTCAANNNACGTATGCCA | 4373 | TGCAGGACCAGAGAATTCGAATA CATCCCCCGANNNACGTATGCCA | 4613 | TGCAGGACCAGAGAATTCGAATA CACAGGACGGNNNACGTATGCCA | 4853 |
| TGCAGGACCAGAGAATTCGAATA CAGTATTCGNNNACGTATGCCA | 4374 | TGCAGGACCAGAGAATTCGAATA CAAGCGATCTNNNACGTATGCCA | 4614 | TGCAGGACCAGAGAATTCGAATA CAATCATGGCNNNACGTATGCCA | 4854 |
| TGCAGGACCAGAGAATTCGAATA CATCCTATATNNNACGTATGCCA | 4375 | TGCAGGACCAGAGAATTCGAATA CACTATAATGNNNACGTATGCCA | 4615 | TGCAGGACCAGAGAATTCGAATA CATATAGGTNNNACGTATGCCA | 4855 |
| TGCAGGACCAGAGAATTCGAATA CAAGTCGTACNNNACGTATGCCA | 4376 | TGCAGGACCAGAGAATTCGAATA CATTCGTCTGNNNACGTATGCCA | 4616 | TGCAGGACCAGAGAATTCGAATA CAGATTTAACNNNACGTATGCCA | 4856 |
| TGCAGGACCAGAGAATTCGAATA CACCTAGACANNNACGTATGCCA | 4377 | TGCAGGACCAGAGAATTCGAATA CAGCGCCTTNNNACGTATGCCA | 4617 | TGCAGGACCAGAGAATTCGAATA CAATGGAACGNNNACGTATGCCA | 4857 |
| TGCAGGACCAGAGAATTCGAATA CAATTGGTCGNNNACGTATGCCA | 4378 | TGCAGGACCAGAGAATTCGAATA CACGCAATCANNNACGTATGCCA | 4618 | TGCAGGACCAGAGAATTCGAATA CAGCTTTCACNNNACGTATGCCA | 4858 |
| TGCAGGACCAGAGAATTCGAATA CAGGTCACGCNNNACGTATGCCA | 4379 | TGCAGGACCAGAGAATTCGAATA CAGTGGGTCGNNNACGTATGCCA | 4619 | TGCAGGACCAGAGAATTCGAATA CAGTCCGTGGNNNACGTATGCCA | 4859 |
| TGCAGGACCAGAGAATTCGAATA CACACCAAACNNNACGTATGCCA | 4380 | TGCAGGACCAGAGAATTCGAATA CATAGCAGGANNNACGTATGCCA | 4620 | TGCAGGACCAGAGAATTCGAATA CATACTCCCANNNACGTATGCCA | 4860 |
| TGCAGGACCAGAGAATTCGAATA CAGAATTCATNNNACGTATGCCA | 4381 | TGCAGGACCAGAGAATTCGAATA CAGATGGAGTNNNACGTATGCCA | 4621 | TGCAGGACCAGAGAATTCGAATA CAGCCCGTCTNNNACGTATGCCA | 4861 |
| TGCAGGACCAGAGAATTCGAATA CATTCGCACTNNNACGTATGCCA | 4382 | TGCAGGACCAGAGAATTCGAATA CAAACGCTNNNACGTATGCCA | 4622 | TGCAGGACCAGAGAATTCGAATA CAGTCACTGNNNACGTATGCCA | 4862 |
| TGCAGGACCAGAGAATTCGAATA CACCGTTAAGNNNACGTATGCCA | 4383 | TGCAGGACCAGAGAATTCGAATA CAAGCGGCCTNNNACGTATGCCA | 4623 | TGCAGGACCAGAGAATTCGAATA CAAGCCGAGGNNNACGTATGCCA | 4863 |
| TGCAGGACCAGAGAATTCGAATA CACGCCTGCTNNNACGTATGCCA | 4384 | TGCAGGACCAGAGAATTCGAATA CACGTTTGCTNNNACGTATGCCA | 4624 | TGCAGGACCAGAGAATTCGAATA CAGCTATATANNNACGTATGCCA | 4864 |
| TGCAGGACCAGAGAATTCGAATA CAAAAACAGTNNNACGTATGCCA | 4385 | TGCAGGACCAGAGAATTCGAATA CACCTGCATTNNNACGTATGCCA | 4625 | TGCAGGACCAGAGAATTCGAATA CATCTCTCGANNNACGTATGCCA | 4865 |
| TGCAGGACCAGAGAATTCGAATA CAGAGATTTNNNACGTATGCCA | 4386 | TGCAGGACCAGAGAATTCGAATA CAATTGAATCNNNACGTATGCCA | 4626 | TGCAGGACCAGAGAATTCGAATA CAACAATAGANNNACGTATGCCA | 4866 |
| TGCAGGACCAGAGAATTCGAATA CAACCAGTTGNNNACGTATGCCA | 4387 | TGCAGGACCAGAGAATTCGAATA CATCCGTGCCNNNACGTATGCCA | 4627 | TGCAGGACCAGAGAATTCGAATA CAGAGAGCATNNNACGTATGCCA | 4867 |
| TGCAGGACCAGAGAATTCGAATA CAAGTTCGCANNNACGTATGCCA | 4388 | TGCAGGACCAGAGAATTCGAATA CATCTCAGGANNNACGTATGCCA | 4628 | TGCAGGACCAGAGAATTCGAATA CACGATATGCNNNACGTATGCCA | 4868 |
| TGCAGGACCAGAGAATTCGAATA CAGATGACCTNNNCTAGCGTTAC | 4389 | TGCAGGACCAGAGAATTCGAATA CAAAGCCGTTNNNCTAGCGTTAC | 4629 | TGCAGGACCAGAGAATTCGAATA CACTTCCTCTNNNCTAGCGTTAC | 4869 |
| TGCAGGACCAGAGAATTCGAATA CACACGTATGNNNCTAGCGTTAC | 4390 | TGCAGGACCAGAGAATTCGAATA CACACCCTCGNNNCTAGCGTTAC | 4630 | TGCAGGACCAGAGAATTCGAATA CAAACAGTTTNNNCTAGCGTTAC | 4870 |
| TGCAGGACCAGAGAATTCGAATA CATGTCGGCGNNNCTAGCGTTAC | 4391 | TGCAGGACCAGAGAATTCGAATA CAGCTAGTTGNNNCTAGCGTTAC | 4631 | TGCAGGACCAGAGAATTCGAATA CATGTGGACTNNNCTAGCGTTAC | 4871 |
| TGCAGGACCAGAGAATTCGAATA CAGACCAAAGNNNCTAGCGTTAC | 4392 | TGCAGGACCAGAGAATTCGAATA CACCGTTACTNNNCTAGCGTTAC | 4632 | TGCAGGACCAGAGAATTCGAATA CACCTCCGCACNNNCTAGCGTTAC | 4872 |
| TGCAGGACCAGAGAATTCGAATA CACTGCTACTNNNCTAGCGTTAC | 4393 | TGCAGGACCAGAGAATTCGAATA CATAGCTCGNNNCTAGCGTTAC | 4633 | TGCAGGACCAGAGAATTCGAATA CACGGTTTCNNNCTAGCGTTAC | 4873 |
| TGCAGGACCAGAGAATTCGAATA CACTCCAACTNNNCTAGCGTTAC | 4394 | TGCAGGACCAGAGAATTCGAATA CAGGTAAACGNNNCTAGCGTTAC | 4634 | TGCAGGACCAGAGAATTCGAATA CAACGTCGATNNNCTAGCGTTAC | 4874 |

FIG. 18C

| Pool-19 | SEQ ID NO: | Pool-20 | SEQ ID NO: | Pool-21 | SEQ ID NO: |
|---|---|---|---|---|---|
| TGCAGGACCAGAGAATTCGAATA CACAATCCCTNNNCTAGCGTTAC | 4395 | TGCAGGACCAGAGAATTCGAATA CAGAACCAGANNNCTAGCGTTAC | 4635 | TGCAGGACCAGAGAATTCGAATA CATTGGCTTCNNNCTAGCGTTAC | 4875 |
| TGCAGGACCAGAGAATTCGAATA CATCGTGCAANNNCTAGCGTTAC | 4396 | TGCAGGACCAGAGAATTCGAATA CAGGACTGTTNNNCTAGCGTTAC | 4636 | TGCAGGACCAGAGAATTCGAATA CAATGGACGANNNCTAGCGTTAC | 4876 |
| TGCAGGACCAGAGAATTCGAATA CAAAGCCATCNNNCTAGCGTTAC | 4397 | TGCAGGACCAGAGAATTCGAATA CAATCGTGTGNNNCTAGCGTTAC | 4637 | TGCAGGACCAGAGAATTCGAATA CATGCAAGAGNNNCTAGCGTTAC | 4877 |
| TGCAGGACCAGAGAATTCGAATA CAATGAACTTNNNCTAGCGTTAC | 4398 | TGCAGGACCAGAGAATTCGAATA CAGTCACGGCNNNCTAGCGTTAC | 4638 | TGCAGGACCAGAGAATTCGAATA CAGAAATATGNNNCTAGCGTTAC | 4878 |
| TGCAGGACCAGAGAATTCGAATA CATGGCCGGTNNNCTAGCGTTAC | 4399 | TGCAGGACCAGAGAATTCGAATA CATCTCGTACNNNCTAGCGTTAC | 4639 | TGCAGGACCAGAGAATTCGAATA CAACACATATNNNCTAGCGTTAC | 4879 |
| TGCAGGACCAGAGAATTCGAATA CATGCCACGGNNNCTAGCGTTAC | 4400 | TGCAGGACCAGAGAATTCGAATA CAAGTCGCGCNNNCTAGCGTTAC | 4640 | TGCAGGACCAGAGAATTCGAATA CAGTACGACTNNNCTAGCGTTAC | 4880 |
| TGCAGGACCAGAGAATTCGAATA CAGTCTTCGTNNNCTAGCGTTAC | 4401 | TGCAGGACCAGAGAATTCGAATA CACATAGTCGNNNCTAGCGTTAC | 4641 | TGCAGGACCAGAGAATTCGAATA CACGCCGCGGNNNCTAGCGTTAC | 4881 |
| TGCAGGACCAGAGAATTCGAATA CAAACGTAGGNNNCTAGCGTTAC | 4402 | TGCAGGACCAGAGAATTCGAATA CACATGTACGNNNCTAGCGTTAC | 4642 | TGCAGGACCAGAGAATTCGAATA CATAGTGCACNNNCTAGCGTTAC | 4882 |
| TGCAGGACCAGAGAATTCGAATA CAATGGAGCANNNCTAGCGTTAC | 4403 | TGCAGGACCAGAGAATTCGAATA CAGGGTATCANNNCTAGCGTTAC | 4643 | TGCAGGACCAGAGAATTCGAATA CATCAATGCGNNNCTAGCGTTAC | 4883 |
| TGCAGGACCAGAGAATTCGAATA CATGGGGCNNNCTAGCGTTAC | 4404 | TGCAGGACCAGAGAATTCGAATA CACAATTCTTNNNCTAGCGTTAC | 4644 | TGCAGGACCAGAGAATTCGAATA CAATGTAAGANNNCTAGCGTTAC | 4884 |
| TGCAGGACCAGAGAATTCGAATA CACTTAGGACNNNCTAGCGTTAC | 4405 | TGCAGGACCAGAGAATTCGAATA CAACTCTATTNNNCTAGCGTTAC | 4645 | TGCAGGACCAGAGAATTCGAATA CATATGTTAGNNNCTAGCGTTAC | 4885 |
| TGCAGGACCAGAGAATTCGAATA CAGACAGAGTNNNCTAGCGTTAC | 4406 | TGCAGGACCAGAGAATTCGAATA CATCATCCGCNNNCTAGCGTTAC | 4646 | TGCAGGACCAGAGAATTCGAATA CATCAAATCANNNCTAGCGTTAC | 4886 |
| TGCAGGACCAGAGAATTCGAATA CAAAGTCGTCNNNCTAGCGTTAC | 4407 | TGCAGGACCAGAGAATTCGAATA CAGGCTTGGCNNNCTAGCGTTAC | 4647 | TGCAGGACCAGAGAATTCGAATA CACACTTAGCNNNCTAGCGTTAC | 4887 |
| TGCAGGACCAGAGAATTCGAATA CATACAAAAGNNNCTAGCGTTAC | 4408 | TGCAGGACCAGAGAATTCGAATA CAGTTCCTTGNNNCTAGCGTTAC | 4648 | TGCAGGACCAGAGAATTCGAATA CATAGGATAANNNCTAGCGTTAC | 4888 |
| TGCAGGACCAGAGAATTCGAATA CATCTCCTGANNNCTAGCGTTAC | 4409 | TGCAGGACCAGAGAATTCGAATA CAATGAGAATNNNCTAGCGTTAC | 4649 | TGCAGGACCAGAGAATTCGAATA CAATCCCGTTNNNCTAGCGTTAC | 4889 |
| TGCAGGACCAGAGAATTCGAATA CAAGCTGGTTNNNCTAGCGTTAC | 4410 | TGCAGGACCAGAGAATTCGAATA CACTGTATCCNNNCTAGCGTTAC | 4650 | TGCAGGACCAGAGAATTCGAATA CAACAATCCGNNNCTAGCGTTAC | 4890 |
| TGCAGGACCAGAGAATTCGAATA CAAATCAAGANNNCTAGCGTTAC | 4411 | TGCAGGACCAGAGAATTCGAATA CATACGCCCCNNNCTAGCGTTAC | 4651 | TGCAGGACCAGAGAATTCGAATA CACTATTAAGNNNCTAGCGTTAC | 4891 |
| TGCAGGACCAGAGAATTCGAATA CAACCACAACNNNCTAGCGTTAC | 4412 | TGCAGGACCAGAGAATTCGAATA CATGGCCGACNNNCTAGCGTTAC | 4652 | TGCAGGACCAGAGAATTCGAATA CAGCGTATGTNNNCTAGCGTTAC | 4892 |
| TGCAGGACCAGAGAATTCGAATA CAGCTATAATNNNCTAGCGTTAC | 4413 | TGCAGGACCAGAGAATTCGAATA CACCGCTGCTNNNCTAGCGTTAC | 4653 | TGCAGGACCAGAGAATTCGAATA CAATTGGTATNNNCTAGCGTTAC | 4893 |
| TGCAGGACCAGAGAATTCGAATA CAGGACCGCTNNNCTAGCGTTAC | 4414 | TGCAGGACCAGAGAATTCGAATA CAGGTAGCCCNNNCTAGCGTTAC | 4654 | TGCAGGACCAGAGAATTCGAATA CATTTCTGCGNNNCTAGCGTTAC | 4894 |
| TGCAGGACCAGAGAATTCGAATA CAGTCCCTATNNNCTAGCGTTAC | 4415 | TGCAGGACCAGAGAATTCGAATA CATGACGTTCNNNCTAGCGTTAC | 4655 | TGCAGGACCAGAGAATTCGAATA CAGAATCCCANNNCTAGCGTTAC | 4895 |
| TGCAGGACCAGAGAATTCGAATA CATTGCTGAGNNNCTAGCGTTAC | 4416 | TGCAGGACCAGAGAATTCGAATA CACCCACTATNNNCTAGCGTTAC | 4656 | TGCAGGACCAGAGAATTCGAATA CACTTTCACGNNNCTAGCGTTAC | 4896 |
| TGCAGGACCAGAGAATTCGAATA CATTGGCCTTNNNCTAGCGTTAC | 4417 | TGCAGGACCAGAGAATTCGAATA CAAAGTGTAANNNCTAGCGTTAC | 4657 | TGCAGGACCAGAGAATTCGAATA CACGGATCATNNNCTAGCGTTAC | 4897 |
| TGCAGGACCAGAGAATTCGAATA CAATCATTTCNNNCTAGCGTTAC | 4418 | TGCAGGACCAGAGAATTCGAATA CAGGAGTATGNNNCTAGCGTTAC | 4658 | TGCAGGACCAGAGAATTCGAATA CAACAGTGCTNNNCTAGCGTTAC | 4898 |
| TGCAGGACCAGAGAATTCGAATA CAGATGTATTNNNCTAGCGTTAC | 4419 | TGCAGGACCAGAGAATTCGAATA CAAGTGATAANNNCTAGCGTTAC | 4659 | TGCAGGACCAGAGAATTCGAATA CACTTAGTCCNNNCTAGCGTTAC | 4899 |
| TGCAGGACCAGAGAATTCGAATA CAGATCATATNNNCTAGCGTTAC | 4420 | TGCAGGACCAGAGAATTCGAATA CATAATTCGANNNCTAGCGTTAC | 4660 | TGCAGGACCAGAGAATTCGAATA CAAGTGCCGGNNNCTAGCGTTAC | 4900 |
| TGCAGGACCAGAGAATTCGAATA CACCCCGCTANNNCTAGCGTTAC | 4421 | TGCAGGACCAGAGAATTCGAATA CAAGCTTTGGNNNCTAGCGTTAC | 4661 | TGCAGGACCAGAGAATTCGAATA CATGAAATCTNNNCTAGCGTTAC | 4901 |
| TGCAGGACCAGAGAATTCGAATA CAAAAATCGANNNCTAGCGTTAC | 4422 | TGCAGGACCAGAGAATTCGAATA CAACATGTCGNNNCTAGCGTTAC | 4662 | TGCAGGACCAGAGAATTCGAATA CATCAGTTAANNNCTAGCGTTAC | 4902 |
| TGCAGGACCAGAGAATTCGAATA CAATGTACATNNNCTAGCGTTAC | 4423 | TGCAGGACCAGAGAATTCGAATA CATCAGCGCGNNNCTAGCGTTAC | 4663 | TGCAGGACCAGAGAATTCGAATA CAAACCCTGANNNCTAGCGTTAC | 4903 |
| TGCAGGACCAGAGAATTCGAATA CAGCCATCTTNNNCTAGCGTTAC | 4424 | TGCAGGACCAGAGAATTCGAATA CAGGCCGTANNNCTAGCGTTAC | 4664 | TGCAGGACCAGAGAATTCGAATA CATCATGATANNNCTAGCGTTAC | 4904 |
| TGCAGGACCAGAGAATTCGAATA CAAATGCTCGNNNCTAGCGTTAC | 4425 | TGCAGGACCAGAGAATTCGAATA CACCATTCACNNNCTAGCGTTAC | 4665 | TGCAGGACCAGAGAATTCGAATA CAAAGCCTTGNNNCTAGCGTTAC | 4905 |
| TGCAGGACCAGAGAATTCGAATA CACACGTCGGNNNCTAGCGTTAC | 4426 | TGCAGGACCAGAGAATTCGAATA CATTCCCCTNNNCTAGCGTTAC | 4666 | TGCAGGACCAGAGAATTCGAATA CAAGCATACCNNNCTAGCGTTAC | 4906 |
| TGCAGGACCAGAGAATTCGAATA CACTATGCGANNNCTAGCGTTAC | 4427 | TGCAGGACCAGAGAATTCGAATA CAACCCTCCGNNNCTAGCGTTAC | 4667 | TGCAGGACCAGAGAATTCGAATA CAGGCATTGNNNCTAGCGTTAC | 4907 |

FIG. 18D

| Pool-19 | SEQ ID NO: | Pool-20 | SEQ ID NO: | Pool-21 | SEQ ID NO: |
|---|---|---|---|---|---|
| TGCAGGACCAGAGAATTCGAATA CAGTCTGGTANNNCTAGCGTTAC | 4428 | TGCAGGACCAGAGAATTCGAATA CACAGCTTACNNNCTAGCGTTAC | 4668 | TGCAGGACCAGAGAATTCGAATA CAGCGAGTCCNNNCTAGCGTTAC | 4908 |
| TGCAGGACCAGAGAATTCGAATA CAGTCAGTGTNNNCTAGCGTTAC | 4429 | TGCAGGACCAGAGAATTCGAATA CAGGAGTTGANNNCTAGCGTTAC | 4669 | TGCAGGACCAGAGAATTCGAATA CATTTTGAGANNNCTAGCGTTAC | 4909 |
| TGCAGGACCAGAGAATTCGAATA CACTCCAGTTNNNCTAGCGTTAC | 4430 | TGCAGGACCAGAGAATTCGAATA CAGACAAGACNNNCTAGCGTTAC | 4670 | TGCAGGACCAGAGAATTCGAATA CAATCCTTATNNNCTAGCGTTAC | 4910 |
| TGCAGGACCAGAGAATTCGAATA CAGATGAAGCNNNCTAGCGTTAC | 4431 | TGCAGGACCAGAGAATTCGAATA CAGTCTACGANNNCTAGCGTTAC | 4671 | TGCAGGACCAGAGAATTCGAATA CATCGAAAAANNNCTAGCGTTAC | 4911 |
| TGCAGGACCAGAGAATTCGAATA CAAAACCATTNNNCTAGCGTTAC | 4432 | TGCAGGACCAGAGAATTCGAATA CATCGCTCATNNNCTAGCGTTAC | 4672 | TGCAGGACCAGAGAATTCGAATA CAGCTCCGTCNNNCTAGCGTTAC | 4912 |
| TGCAGGACCAGAGAATTCGAATA CACCTGCGCTNNNCTAGCGTTAC | 4433 | TGCAGGACCAGAGAATTCGAATA CACCAAGCCGNNNCTAGCGTTAC | 4673 | TGCAGGACCAGAGAATTCGAATA CACCAGTTTCNNNCTAGCGTTAC | 4913 |
| TGCAGGACCAGAGAATTCGAATA CACACCCGAGNNNCTAGCGTTAC | 4434 | TGCAGGACCAGAGAATTCGAATA CACCCTCGGTNNNCTAGCGTTAC | 4674 | TGCAGGACCAGAGAATTCGAATA CACTTGGCTTNNNCTAGCGTTAC | 4914 |
| TGCAGGACCAGAGAATTCGAATA CATACTACAANNNCTAGCGTTAC | 4435 | TGCAGGACCAGAGAATTCGAATA CAAACTAGTTNNNCTAGCGTTAC | 4675 | TGCAGGACCAGAGAATTCGAATA CACCGCCATCNNNCTAGCGTTAC | 4915 |
| TGCAGGACCAGAGAATTCGAATA CATAACCGACNNNCTAGCGTTAC | 4436 | TGCAGGACCAGAGAATTCGAATA CAGAGTGAGTNNNCTAGCGTTAC | 4676 | TGCAGGACCAGAGAATTCGAATA CAGATCGATCNNNCTAGCGTTAC | 4916 |
| TGCAGGACCAGAGAATTCGAATA CATCTATAGANNNCTAGCGTTAC | 4437 | TGCAGGACCAGAGAATTCGAATA CACAATACTANNNCTAGCGTTAC | 4677 | TGCAGGACCAGAGAATTCGAATA CAACSCGGCTNNNCTAGCGTTAC | 4917 |
| TGCAGGACCAGAGAATTCGAATA CAGGTGAGGCNNNCTAGCGTTAC | 4438 | TGCAGGACCAGAGAATTCGAATA CACCTTTGGTNNNCTAGCGTTAC | 4678 | TGCAGGACCAGAGAATTCGAATA CATCTCGAGANNNCTAGCGTTAC | 4918 |
| TGCAGGACCAGAGAATTCGAATA CACATACTCCNNNCTAGCGTTAC | 4439 | TGCAGGACCAGAGAATTCGAATA CATTCACACCNNNCTAGCGTTAC | 4679 | TGCAGGACCAGAGAATTCGAATA CAATTGGCACNNNCTAGCGTTAC | 4919 |
| TGCAGGACCAGAGAATTCGAATA CATAAGAGTANNNCTAGCGTTAC | 4440 | TGCAGGACCAGAGAATTCGAATA CAGTTATCCCNNNCTAGCGTTAC | 4680 | TGCAGGACCAGAGAATTCGAATA CACGCCGAGTNNNCTAGCGTTAC | 4920 |
| TGCAGGACCAGAGAATTCGAATA CAGTGTGAGANNNCTAGCGTTAC | 4441 | TGCAGGACCAGAGAATTCGAATA CAAAACTTGTNNNCTAGCGTTAC | 4681 | TGCAGGACCAGAGAATTCGAATA CACTTCAGCTNNNCTAGCGTTAC | 4921 |
| TGCAGGACCAGAGAATTCGAATA CATTCCCGATNNNCTAGCGTTAC | 4442 | TGCAGGACCAGAGAATTCGAATA CACAACCCAANNNCTAGCGTTAC | 4682 | TGCAGGACCAGAGAATTCGAATA CAAAATAAGCNNNCTAGCGTTAC | 4922 |
| TGCAGGACCAGAGAATTCGAATA CAAGTACGAGNNNCTAGCGTTAC | 4443 | TGCAGGACCAGAGAATTCGAATA CAGTTCACGANNNCTAGCGTTAC | 4683 | TGCAGGACCAGAGAATTCGAATA CAGCCTAAGTNNNCTAGCGTTAC | 4923 |
| TGCAGGACCAGAGAATTCGAATA CAGGTGAACANNNCTAGCGTTAC | 4444 | TGCAGGACCAGAGAATTCGAATA CACGTCTACTNNNCTAGCGTTAC | 4684 | TGCAGGACCAGAGAATTCGAATA CAGATGTTCGNNNCTAGCGTTAC | 4924 |
| TGCAGGACCAGAGAATTCGAATA CACACTAGCANNNCTAGCGTTAC | 4445 | TGCAGGACCAGAGAATTCGAATA CATCAACAGCNNNCTAGCGTTAC | 4685 | TGCAGGACCAGAGAATTCGAATA CAAACGAGGTNNNCTAGCGTTAC | 4925 |
| TGCAGGACCAGAGAATTCGAATA CAAGCAGAACNNNCTAGCGTTAC | 4446 | TGCAGGACCAGAGAATTCGAATA CATTGAGTCGNNNCTAGCGTTAC | 4686 | TGCAGGACCAGAGAATTCGAATA CAATAGACAANNNCTAGCGTTAC | 4926 |
| TGCAGGACCAGAGAATTCGAATA CATTTTAAAANNNCTAGCGTTAC | 4447 | TGCAGGACCAGAGAATTCGAATA CAGCATCTGANNNCTAGCGTTAC | 4687 | TGCAGGACCAGAGAATTCGAATA CATATTTGGANNNCTAGCGTTAC | 4927 |
| TGCAGGACCAGAGAATTCGAATA CACTTCGAGANNNCTAGCGTTAC | 4448 | TGCAGGACCAGAGAATTCGAATA CATGCATGTTNNNCTAGCGTTAC | 4688 | TGCAGGACCAGAGAATTCGAATA CATCCGTTGTNNNCTAGCGTTAC | 4928 |
| TGCAGGACCAGAGAATTCGAATA CATGCAATGCNNNGATCGACATG | 4449 | TGCAGGACCAGAGAATTCGAATA CAGATCTCTCNNNGATCGACATG | 4689 | TGCAGGACCAGAGAATTCGAATA CATCCTCGATNNNGATCGACATG | 4929 |
| TGCAGGACCAGAGAATTCGAATA CAGACCGCCANNNGATCGACATG | 4450 | TGCAGGACCAGAGAATTCGAATA CAGAGCGCGANNNGATCGACATG | 4690 | TGCAGGACCAGAGAATTCGAATA CATTTGGAGNNNNGATCGACATG | 4930 |
| TGCAGGACCAGAGAATTCGAATA CAGTTTTTCANNNGATCGACATG | 4451 | TGCAGGACCAGAGAATTCGAATA CACTCTCTAGNNNGATCGACATG | 4691 | TGCAGGACCAGAGAATTCGAATA CACTTCCACANNNGATCGACATG | 4931 |
| TGCAGGACCAGAGAATTCGAATA CAGTTTTATCNNNGATCGACATG | 4452 | TGCAGGACCAGAGAATTCGAATA CACGTGGCGTNNNGATCGACATG | 4692 | TGCAGGACCAGAGAATTCGAATA CAAATTTGCANNNGATCGACATG | 4932 |
| TGCAGGACCAGAGAATTCGAATA CAACACCGGCNNNGATCGACATG | 4453 | TGCAGGACCAGAGAATTCGAATA CAAGCTAGTCNNNGATCGACATG | 4693 | TGCAGGACCAGAGAATTCGAATA CAAATCTGATNNNGATCGACATG | 4933 |
| TGCAGGACCAGAGAATTCGAATA CACGCTTTACNNNGATCGACATG | 4454 | TGCAGGACCAGAGAATTCGAATA CAGCTATGTNNNNGATCGACATG | 4694 | TGCAGGACCAGAGAATTCGAATA CATCCACTTGNNNGATCGACATG | 4934 |
| TGCAGGACCAGAGAATTCGAATA CAGTAAATGANNNGATCGACATG | 4455 | TGCAGGACCAGAGAATTCGAATA CATCTGCTTGNNNGATCGACATG | 4695 | TGCAGGACCAGAGAATTCGAATA CATGGTTAGCNNNGATCGACATG | 4935 |
| TGCAGGACCAGAGAATTCGAATA CATTTGAAGTNNNGATCGACATG | 4456 | TGCAGGACCAGAGAATTCGAATA CAGTACGCTANNNGATCGACATG | 4696 | TGCAGGACCAGAGAATTCGAATA CACTGTAACGNNNGATCGACATG | 4936 |
| TGCAGGACCAGAGAATTCGAATA CACACCACTTNNNGATCGACATG | 4457 | TGCAGGACCAGAGAATTCGAATA CAGACCCGTGNNNGATCGACATG | 4697 | TGCAGGACCAGAGAATTCGAATA CATATTAGTGNNNGATCGACATG | 4937 |
| TGCAGGACCAGAGAATTCGAATA CATGTAAGAANNNGATCGACATG | 4458 | TGCAGGACCAGAGAATTCGAATA CAGTCATGACNNNGATCGACATG | 4698 | TGCAGGACCAGAGAATTCGAATA CATGCACATGNNNGATCGACATG | 4938 |
| TGCAGGACCAGAGAATTCGAATA CACGCTGAATNNNGATCGACATG | 4459 | TGCAGGACCAGAGAATTCGAATA CACGCTAGAANNNGATCGACATG | 4699 | TGCAGGACCAGAGAATTCGAATA CAACCTTGCANNNGATCGACATG | 4939 |
| TGCAGGACCAGAGAATTCGAATA CACTTATTGTNNNGATCGACATG | 4460 | TGCAGGACCAGAGAATTCGAATA CAGTAATGAANNNGATCGACATG | 4700 | TGCAGGACCAGAGAATTCGAATA CAGCGTGCACNNNGATCGACATG | 4940 |

FIG. 18E

| Pool-19 | SEQ ID NO: | Pool-20 | SEQ ID NO: | Pool-21 | SEQ ID NO: |
|---|---|---|---|---|---|
| TGCAGGACCAGAGAATTCGAATA CACGTGAGAANNNGATCGACATG | 4461 | TGCAGGACCAGAGAATTCGAATA CATCGTATTTNNNGATCGACATG | 4701 | TGCAGGACCAGAGAATTCGAATA CACGGCCTTTANNNGATCGACATG | 4941 |
| TGCAGGACCAGAGAATTCGAATA CAACCGGCTGNNNGATCGACATG | 4462 | TGCAGGACCAGAGAATTCGAATA CACACGTACANNNGATCGACATG | 4702 | TGCAGGACCAGAGAATTCGAATA CATTGTAAACNNNGATCGACATG | 4942 |
| TGCAGGACCAGAGAATTCGAATA CACAAAATTCNNNGATCGACATG | 4463 | TGCAGGACCAGAGAATTCGAATA CATGACTAATNNNGATCGACATG | 4703 | TGCAGGACCAGAGAATTCGAATA CAAACGCAAGNNNGATCGACATG | 4943 |
| TGCAGGACCAGAGAATTCGAATA CAACTAAAGANNNGATCGACATG | 4464 | TGCAGGACCAGAGAATTCGAATA CACTACCGCCNNNGATCGACATG | 4704 | TGCAGGACCAGAGAATTCGAATA CAGTAATCATNNNGATCGACATG | 4944 |
| TGCAGGACCAGAGAATTCGAATA CATAGTCTCCNNNGATCGACATG | 4465 | TGCAGGACCAGAGAATTCGAATA CAGGCACTTANNNGATCGACATG | 4705 | TGCAGGACCAGAGAATTCGAATA CAGTCTGCTTNNNGATCGACATG | 4945 |
| TGCAGGACCAGAGAATTCGAATA CACTAACATANNNGATCGACATG | 4466 | TGCAGGACCAGAGAATTCGAATA CATCCTTAGCNNNGATCGACATG | 4706 | TGCAGGACCAGAGAATTCGAATA CAGATGGTTCNNNGATCGACATG | 4946 |
| TGCAGGACCAGAGAATTCGAATA CATGCACGCGNNNGATCGACATG | 4467 | TGCAGGACCAGAGAATTCGAATA CAGCTATAGCNNNGATCGACATG | 4707 | TGCAGGACCAGAGAATTCGAATA CACTTGGCAANNNGATCGACATG | 4947 |
| TGCAGGACCAGAGAATTCGAATA CAACTGGAAGNNNGATCGACATG | 4468 | TGCAGGACCAGAGAATTCGAATA CAAATGAACANNNGATCGACATG | 4708 | TGCAGGACCAGAGAATTCGAATA CATACCGAACNNNGATCGACATG | 4948 |
| TGCAGGACCAGAGAATTCGAATA CAGCAATCCANNNGATCGACATG | 4469 | TGCAGGACCAGAGAATTCGAATA CAGTAGTAANNNNGATCGACATG | 4709 | TGCAGGACCAGAGAATTCGAATA CAGTGAGTGANNNGATCGACATG | 4949 |
| TGCAGGACCAGAGAATTCGAATA CAAATCCTAANNNGATCGACATG | 4470 | TGCAGGACCAGAGAATTCGAATA CATAGTTCCGNNNGATCGACATG | 4710 | TGCAGGACCAGAGAATTCGAATA CACAGGTCGANNNGATCGACATG | 4950 |
| TGCAGGACCAGAGAATTCGAATA CAAAGCGGTANNNGATCGACATG | 4471 | TGCAGGACCAGAGAATTCGAATA CAGTTGTGACNNNGATCGACATG | 4711 | TGCAGGACCAGAGAATTCGAATA CAAGGTCAGANNNGATCGACATG | 4951 |
| TGCAGGACCAGAGAATTCGAATA CAGTCAGAGANNNGATCGACATG | 4472 | TGCAGGACCAGAGAATTCGAATA CACGGTAGCNNNNGATCGACATG | 4712 | TGCAGGACCAGAGAATTCGAATA CAGAGCGTTTNNNGATCGACATG | 4952 |
| TGCAGGACCAGAGAATTCGAATA CATCGGATGTNNNGATCGACATG | 4473 | TGCAGGACCAGAGAATTCGAATA CACTATGTGNNNNGATCGACATG | 4713 | TGCAGGACCAGAGAATTCGAATA CAGAAATGGCNNNGATCGACATG | 4953 |
| TGCAGGACCAGAGAATTCGAATA CATCACGCTTNNNGATCGACATG | 4474 | TGCAGGACCAGAGAATTCGAATA CATTGGGTANNNNGATCGACATG | 4714 | TGCAGGACCAGAGAATTCGAATA CAGAGTGTCNNNNGATCGACATG | 4954 |
| TGCAGGACCAGAGAATTCGAATA CATTAGGTGCNNNGATCGACATG | 4475 | TGCAGGACCAGAGAATTCGAATA CAATTATCCTNNNGATCGACATG | 4715 | TGCAGGACCAGAGAATTCGAATA CAAAACATCTNNNGATCGACATG | 4955 |
| TGCAGGACCAGAGAATTCGAATA CATCCGACGGNNNGATCGACATG | 4476 | TGCAGGACCAGAGAATTCGAATA CACTTTGAAANNNGATCGACATG | 4716 | TGCAGGACCAGAGAATTCGAATA CATAAAGCTTNNNGATCGACATG | 4956 |
| TGCAGGACCAGAGAATTCGAATA CAAAAGCAGCNNNGATCGACATG | 4477 | TGCAGGACCAGAGAATTCGAATA CACTAGTACGNNNGATCGACATG | 4717 | TGCAGGACCAGAGAATTCGAATA CATTAGTGCGNNNGATCGACATG | 4957 |
| TGCAGGACCAGAGAATTCGAATA CAGTGCCGGTNNNGATCGACATG | 4478 | TGCAGGACCAGAGAATTCGAATA CATCCCACATNNNGATCGACATG | 4718 | TGCAGGACCAGAGAATTCGAATA CAGTTCGCCNNNNGATCGACATG | 4958 |
| TGCAGGACCAGAGAATTCGAATA CAACGATATTNNNGATCGACATG | 4479 | TGCAGGACCAGAGAATTCGAATA CAGTATCGACNNNGATCGACATG | 4719 | TGCAGGACCAGAGAATTCGAATA CAGTGACCTANNNGATCGACATG | 4959 |
| TGCAGGACCAGAGAATTCGAATA CAACAACAGGNNNGATCGACATG | 4480 | TGCAGGACCAGAGAATTCGAATA CAGGCCTCAGNNNGATCGACATG | 4720 | TGCAGGACCAGAGAATTCGAATA CAGGACAATGNNNGATCGACATG | 4960 |
| TGCAGGACCAGAGAATTCGAATA CACTCCGAAANNNGATCGACATG | 4481 | TGCAGGACCAGAGAATTCGAATA CACGGCTTANNNNGATCGACATG | 4721 | TGCAGGACCAGAGAATTCGAATA CATATAGGAANNNGATCGACATG | 4961 |
| TGCAGGACCAGAGAATTCGAATA CATCAAGCCANNNGATCGACATG | 4482 | TGCAGGACCAGAGAATTCGAATA CACATAGCACNNNGATCGACATG | 4722 | TGCAGGACCAGAGAATTCGAATA CACTAGCGGCNNNGATCGACATG | 4962 |
| TGCAGGACCAGAGAATTCGAATA CACATTAACANNNGATCGACATG | 4483 | TGCAGGACCAGAGAATTCGAATA CACCCACTTTNNNGATCGACATG | 4723 | TGCAGGACCAGAGAATTCGAATA CAGCGTTTAGNNNGATCGACATG | 4963 |
| TGCAGGACCAGAGAATTCGAATA CAAACACGAGNNNGATCGACATG | 4484 | TGCAGGACCAGAGAATTCGAATA CATGTGATGCNNNGATCGACATG | 4724 | TGCAGGACCAGAGAATTCGAATA CAGTATGTCGNNNGATCGACATG | 4964 |
| TGCAGGACCAGAGAATTCGAATA CATCCATCACNNNGATCGACATG | 4485 | TGCAGGACCAGAGAATTCGAATA CAATCGCTAGNNNGATCGACATG | 4725 | TGCAGGACCAGAGAATTCGAATA CACATGTGACNNNGATCGACATG | 4965 |
| TGCAGGACCAGAGAATTCGAATA CAGTCGCACGNNNGATCGACATG | 4486 | TGCAGGACCAGAGAATTCGAATA CAGAATTAGANNNGATCGACATG | 4726 | TGCAGGACCAGAGAATTCGAATA CAATCAAAGNNNNGATCGACATG | 4966 |
| TGCAGGACCAGAGAATTCGAATA CATGGCACGCNNNGATCGACATG | 4487 | TGCAGGACCAGAGAATTCGAATA CAGCGGTCGTNNNGATCGACATG | 4727 | TGCAGGACCAGAGAATTCGAATA CAATAAACTCNNNGATCGACATG | 4967 |
| TGCAGGACCAGAGAATTCGAATA CATTTCAGAANNNGATCGACATG | 4488 | TGCAGGACCAGAGAATTCGAATA CAAATTGCATNNNGATCGACATG | 4728 | TGCAGGACCAGAGAATTCGAATA CACCGGATCGNNNGATCGACATG | 4968 |
| TGCAGGACCAGAGAATTCGAATA CATACGTCTCNNNGATCGACATG | 4489 | TGCAGGACCAGAGAATTCGAATA CATGGAACCTNNNGATCGACATG | 4729 | TGCAGGACCAGAGAATTCGAATA CACCCGCTAGNNNGATCGACATG | 4969 |
| TGCAGGACCAGAGAATTCGAATA CACCGGATCTTNNGATCGACATG | 4490 | TGCAGGACCAGAGAATTCGAATA CAAGCGCATTNNNGATCGACATG | 4730 | TGCAGGACCAGAGAATTCGAATA CACTGTGGTANNNGATCGACATG | 4970 |
| TGCAGGACCAGAGAATTCGAATA CAATTAAGCTNNNGATCGACATG | 4491 | TGCAGGACCAGAGAATTCGAATA CATTCCCTCTNNNGATCGACATG | 4731 | TGCAGGACCAGAGAATTCGAATA CAGAACGTGANNNGATCGACATG | 4971 |
| TGCAGGACCAGAGAATTCGAATA CAAACTTCCCNNNGATCGACATG | 4492 | TGCAGGACCAGAGAATTCGAATA CAATTGTCGGNNNGATCGACATG | 4732 | TGCAGGACCAGAGAATTCGAATA CACGGCTAANNNNGATCGACATG | 4972 |
| TGCAGGACCAGAGAATTCGAATA CAGTCGCTTTNNNGATCGACATG | 4493 | TGCAGGACCAGAGAATTCGAATA CATAATGCGCNNNGATCGACATG | 4733 | TGCAGGACCAGAGAATTCGAATA CAGGCATCATNNNGATCGACATG | 4973 |

FIG. 18F

| Pool-19 | SEQ ID NO: | Pool-20 | SEQ ID NO: | Pool-21 | SEQ ID NO: |
|---|---|---|---|---|---|
| TGCAGGACCAGAGAATTCGAATA CAGCCAGTATNNNGATCGACATG | 4494 | TGCAGGACCAGAGAATTCGAATA CAACGCCATTGNNNGATCGACATG | 4734 | TGCAGGACCAGAGAATTCGAATA CACCGCAGGTNNNGATCGACATG | 4974 |
| TGCAGGACCAGAGAATTCGAATA CAGAGAAAAANNNGATCGACATG | 4495 | TGCAGGACCAGAGAATTCGAATA CATGTCCGTANNNGATCGACATG | 4735 | TGCAGGACCAGAGAATTCGAATA CATCCTACTGNNNGATCGACATG | 4975 |
| TGCAGGACCAGAGAATTCGAATA CAATAGCCCANNNGATCGACATG | 4496 | TGCAGGACCAGAGAATTCGAATA CATTTTCAACNNNGATCGACATG | 4736 | TGCAGGACCAGAGAATTCGAATA CATCCCGACCNNNGATCGACATG | 4976 |
| TGCAGGACCAGAGAATTCGAATA CACACGTCCCNNNGATCGACATG | 4497 | TGCAGGACCAGAGAATTCGAATA CATAAGTACTNNNGATCGACATG | 4737 | TGCAGGACCAGAGAATTCGAATA CATGTAGGTCNNNGATCGACATG | 4977 |
| TGCAGGACCAGAGAATTCGAATA CAAAGTTATCNNNGATCGACATG | 4498 | TGCAGGACCAGAGAATTCGAATA CAAATTAGTCNNNGATCGACATG | 4738 | TGCAGGACCAGAGAATTCGAATA CACGGCGCTANNNGATCGACATG | 4978 |
| TGCAGGACCAGAGAATTCGAATA CACTTTTCGGNNNGATCGACATG | 4499 | TGCAGGACCAGAGAATTCGAATA CAGGAAATATNNNGATCGACATG | 4739 | TGCAGGACCAGAGAATTCGAATA CACCTATTTANNNGATCGACATG | 4979 |
| TGCAGGACCAGAGAATTCGAATA CACAATCGTGNNNGATCGACATG | 4500 | TGCAGGACCAGAGAATTCGAATA CATTTTTTAANNNGATCGACATG | 4740 | TGCAGGACCAGAGAATTCGAATA CAGAACAAGCNNNGATCGACATG | 4980 |
| TGCAGGACCAGAGAATTCGAATA CAGGACGTAANNNGATCGACATG | 4501 | TGCAGGACCAGAGAATTCGAATA CACACGTAACNNNGATCGACATG | 4741 | TGCAGGACCAGAGAATTCGAATA CATCCATTGNNNGATCGACATG | 4981 |
| TGCAGGACCAGAGAATTCGAATA CACCCGAACGNNNGATCGACATG | 4502 | TGCAGGACCAGAGAATTCGAATA CAGTTTCCGTNNNGATCGACATG | 4742 | TGCAGGACCAGAGAATTCGAATA CATACTGTGGNNNGATCGACATG | 4982 |
| TGCAGGACCAGAGAATTCGAATA CATCCGTATCNNNGATCGACATG | 4503 | TGCAGGACCAGAGAATTCGAATA CAAGTATCTANNNGATCGACATG | 4743 | TGCAGGACCAGAGAATTCGAATA CAGCGCTTANNNGATCGACATG | 4983 |
| TGCAGGACCAGAGAATTCGAATA CATTTCGTTANNNGATCGACATG | 4504 | TGCAGGACCAGAGAATTCGAATA CATCTAGTGNNNGATCGACATG | 4744 | TGCAGGACCAGAGAATTCGAATA CAGCCCTCCCANNNGATCGACATG | 4984 |
| TGCAGGACCAGAGAATTCGAATA CATGCTACAGNNNGATCGACATG | 4505 | TGCAGGACCAGAGAATTCGAATA CAGAGTAGNGATANNNGATCGACATG | 4745 | TGCAGGACCAGAGAATTCGAATA CACACGATANNNGATCGACATG | 4985 |
| TGCAGGACCAGAGAATTCGAATA CAGTTACTTTNNNGATCGACATG | 4506 | TGCAGGACCAGAGAATTCGAATA CAACTCCAGANNNGATCGACATG | 4746 | TGCAGGACCAGAGAATTCGAATA CAGTGTCAACNNNGATCGACATG | 4986 |
| TGCAGGACCAGAGAATTCGAATA CAAATGCCTGNNNGATCGACATG | 4507 | TGCAGGACCAGAGAATTCGAATA CAAAACACAANNNGATCGACATG | 4747 | TGCAGGACCAGAGAATTCGAATA CATACGCCGNNNGATCGACATG | 4987 |
| TGCAGGACCAGAGAATTCGAATA CACCAGGCACNNNGATCGACATG | 4508 | TGCAGGACCAGAGAATTCGAATA CAGCCGCAACNNNGATCGACATG | 4748 | TGCAGGACCAGAGAATTCGAATA CAAATCGACNNNGATCGACATG | 4988 |
| TGCAGGACCAGAGAATTCGAATA CATGGCGACCNNNTGCATCAGGT | 4509 | TGCAGGACCAGAGAATTCGAATA CAGATCTTAANNNTGCATCAGGT | 4749 | TGCAGGACCAGAGAATTCGAATA CAGCCGCCGNNNTGCATCAGGT | 4989 |
| TGCAGGACCAGAGAATTCGAATA CAAAGAGGCTNNNTGCATCAGGT | 4510 | TGCAGGACCAGAGAATTCGAATA CACTAGAGTCNNNTGCATCAGGT | 4750 | TGCAGGACCAGAGAATTCGAATA CACCTGCCGTNNNTGCATCAGGT | 4990 |
| TGCAGGACCAGAGAATTCGAATA CATTACCCACNNNTGCATCAGGT | 4511 | TGCAGGACCAGAGAATTCGAATA CAGCATTCTCNNNTGCATCAGGT | 4751 | TGCAGGACCAGAGAATTCGAATA CACGTTACCTNNNTGCATCAGGT | 4991 |
| TGCAGGACCAGAGAATTCGAATA CATGCGGATTNNNTGCATCAGGT | 4512 | TGCAGGACCAGAGAATTCGAATA CAGCAGCCACNNNTGCATCAGGT | 4752 | TGCAGGACCAGAGAATTCGAATA CACGATTAGCNNNTGCATCAGGT | 4992 |
| TGCAGGACCAGAGAATTCGAATA CACAGGTTGTNNNTGCATCAGGT | 4513 | TGCAGGACCAGAGAATTCGAATA CAAGCTGCGCNNNTGCATCAGGT | 4753 | TGCAGGACCAGAGAATTCGAATA CAAACCTAATNNNTGCATCAGGT | 4993 |
| TGCAGGACCAGAGAATTCGAATA CAAACATAGANNNTGCATCAGGT | 4514 | TGCAGGACCAGAGAATTCGAATA CACCCGCTANNNTGCATCAGGT | 4754 | TGCAGGACCAGAGAATTCGAATA CAATCGGCTANNNTGCATCAGGT | 4994 |
| TGCAGGACCAGAGAATTCGAATA CAGAAATGATNNNTGCATCAGGT | 4515 | TGCAGGACCAGAGAATTCGAATA CACACAAGGCAANNNTGCATCAGGT | 4755 | TGCAGGACCAGAGAATTCGAATA CAGGAACCCNNNTGCATCAGGT | 4995 |
| TGCAGGACCAGAGAATTCGAATA CATGTGCTGANNNTGCATCAGGT | 4516 | TGCAGGACCAGAGAATTCGAATA CAGATGTTATNNNTGCATCAGGT | 4756 | TGCAGGACCAGAGAATTCGAATA CATCCACAGNNNTGCATCAGGT | 4996 |
| TGCAGGACCAGAGAATTCGAATA CAAGGCAGATNNNTGCATCAGGT | 4517 | TGCAGGACCAGAGAATTCGAATA CACGGTATTGNNNTGCATCAGGT | 4757 | TGCAGGACCAGAGAATTCGAATA CACTATTGAANNNTGCATCAGGT | 4997 |
| TGCAGGACCAGAGAATTCGAATA CATAGGTTATNNNTGCATCAGGT | 4518 | TGCAGGACCAGAGAATTCGAATA CAGTATTTAGNNNTGCATCAGGT | 4758 | TGCAGGACCAGAGAATTCGAATA CACGCGATATNNNTGCATCAGGT | 4998 |
| TGCAGGACCAGAGAATTCGAATA CATTTTTGTGNNNTGCATCAGGT | 4519 | TGCAGGACCAGAGAATTCGAATA CAGGATCAGANNNTGCATCAGGT | 4759 | TGCAGGACCAGAGAATTCGAATA CACTTATGTTNNNTGCATCAGGT | 4999 |
| TGCAGGACCAGAGAATTCGAATA CAAAACAAGTNNNTGCATCAGGT | 4520 | TGCAGGACCAGAGAATTCGAATA CAATCGAAAANNNTGCATCAGGT | 4760 | TGCAGGACCAGAGAATTCGAATA CAATTTGGTANNNTGCATCAGGT | 5000 |
| TGCAGGACCAGAGAATTCGAATA CACGTGGTTANNNTGCATCAGGT | 4521 | TGCAGGACCAGAGAATTCGAATA CAGCCATTTCNNNTGCATCAGGT | 4761 | TGCAGGACCAGAGAATTCGAATA CAAGGCAACANNNTGCATCAGGT | 5001 |
| TGCAGGACCAGAGAATTCGAATA CACTTTCGACNNNTGCATCAGGT | 4522 | TGCAGGACCAGAGAATTCGAATA CATCAGACCANNNTGCATCAGGT | 4762 | TGCAGGACCAGAGAATTCGAATA CAGACCTTTCNNNTGCATCAGGT | 5002 |
| TGCAGGACCAGAGAATTCGAATA CATAGACGTCNNNTGCATCAGGT | 4523 | TGCAGGACCAGAGAATTCGAATA CATTTGTTCANNNTGCATCAGGT | 4763 | TGCAGGACCAGAGAATTCGAATA CAGGAACCCANNNTGCATCAGGT | 5003 |
| TGCAGGACCAGAGAATTCGAATA CATCTAGTCNNNTGCATCAGGT | 4524 | TGCAGGACCAGAGAATTCGAATA CAACCCTATCNNNTGCATCAGGT | 4764 | TGCAGGACCAGAGAATTCGAATA CACGTGTAACNNNTGCATCAGGT | 5004 |
| TGCAGGACCAGAGAATTCGAATA CAAACAAGATNNNTGCATCAGGT | 4525 | TGCAGGACCAGAGAATTCGAATA CAAAAGCCGNNNTGCATCAGGT | 4765 | TGCAGGACCAGAGAATTCGAATA CACAGATCCANNNTGCATCAGGT | 5005 |
| TGCAGGACCAGAGAATTCGAATA CATAATGAAGNNNTGCATCAGGT | 4526 | TGCAGGACCAGAGAATTCGAATA CAGAGTGCGGNNNTGCATCAGGT | 4766 | TGCAGGACCAGAGAATTCGAATA CACCAGCACGNNNTGCATCAGGT | 5006 |

FIG. 18G

| Pool-19 | SEQ ID NO: | Pool-20 | SEQ ID NO: | Pool-21 | SEQ ID NO: |
|---|---|---|---|---|---|
| TGCAGGACCAGAGAATTCGAATA CATATTCGCCNNNTGCATCAGGT | 4527 | TGCAGGACCAGAGAATTCGAATA CAATCATACANNNTGCATCAGGT | 4767 | TGCAGGACCAGAGAATTCGAATA CACGAGTCCGNNNTGCATCAGGT | 5007 |
| TGCAGGACCAGAGAATTCGAATA CATTGCACGANNNTGCATCAGGT | 4528 | TGCAGGACCAGAGAATTCGAATA CACAGATGAGNNNTGCATCAGGT | 4768 | TGCAGGACCAGAGAATTCGAATA CAGTCGAATCNNNTGCATCAGGT | 5008 |
| TGCAGGACCAGAGAATTCGAATA CAACTACTAANNNTGCATCAGGT | 4529 | TGCAGGACCAGAGAATTCGAATA CACAGCTTAGNNNTGCATCAGGT | 4769 | TGCAGGACCAGAGAATTCGAATA CATCCATAAANNNTGCATCAGGT | 5009 |
| TGCAGGACCAGAGAATTCGAATA CAACTCATAANNNTGCATCAGGT | 4530 | TGCAGGACCAGAGAATTCGAATA CAACTTCTTANNNTGCATCAGGT | 4770 | TGCAGGACCAGAGAATTCGAATA CAGTCCCACCNNNTGCATCAGGT | 5010 |
| TGCAGGACCAGAGAATTCGAATA CAAGGACTGANNNTGCATCAGGT | 4531 | TGCAGGACCAGAGAATTCGAATA CACAACAGAGNNNTGCATCAGGT | 4771 | TGCAGGACCAGAGAATTCGAATA CATGGTTGACNNNTGCATCAGGT | 5011 |
| TGCAGGACCAGAGAATTCGAATA CACACATCCTNNNTGCATCAGGT | 4532 | TGCAGGACCAGAGAATTCGAATA CACGTAGATCNNNTGCATCAGGT | 4772 | TGCAGGACCAGAGAATTCGAATA CAAGACAACGNNNTGCATCAGGT | 5012 |
| TGCAGGACCAGAGAATTCGAATA CAATAGCGAGNNNTGCATCAGGT | 4533 | TGCAGGACCAGAGAATTCGAATA CACCTCCGANNNTGCATCAGGT | 4773 | TGCAGGACCAGAGAATTCGAATA CAATATTCAGNNNTGCATCAGGT | 5013 |
| TGCAGGACCAGAGAATTCGAATA CAAGGAAGTCNNNTGCATCAGGT | 4534 | TGCAGGACCAGAGAATTCGAATA CAGACTTTGGNNNTGCATCAGGT | 4774 | TGCAGGACCAGAGAATTCGAATA CAGACGAATCNNNTGCATCAGGT | 5014 |
| TGCAGGACCAGAGAATTCGAATA CAGAAGCCTTNNNTGCATCAGGT | 4535 | TGCAGGACCAGAGAATTCGAATA CAGAACATCCNNNTGCATCAGGT | 4775 | TGCAGGACCAGAGAATTCGAATA CAGAGAACCNNNTGCATCAGGT | 5015 |
| TGCAGGACCAGAGAATTCGAATA CACCCCCTTCNNNTGCATCAGGT | 4536 | TGCAGGACCAGAGAATTCGAATA CACACATCANNNTGCATCAGGT | 4776 | TGCAGGACCAGAGAATTCGAATA CAGCAACAAGNNNTGCATCAGGT | 5016 |
| TGCAGGACCAGAGAATTCGAATA CAAGAAACCGNNNTGCATCAGGT | 4537 | TGCAGGACCAGAGAATTCGAATA CACTTCTGACNNNTGCATCAGGT | 4777 | TGCAGGACCAGAGAATTCGAATA CACTAAACCGNNNTGCATCAGGT | 5017 |
| TGCAGGACCAGAGAATTCGAATA CAGACATCTGNNNTGCATCAGGT | 4538 | TGCAGGACCAGAGAATTCGAATA CATCCCGTTANNNTGCATCAGGT | 4778 | TGCAGGACCAGAGAATTCGAATA CAGGAGGTCCNNNTGCATCAGGT | 5018 |
| TGCAGGACCAGAGAATTCGAATA CAACGCCCTCNNNTGCATCAGGT | 4539 | TGCAGGACCAGAGAATTCGAATA CATTTCCATANNNTGCATCAGGT | 4779 | TGCAGGACCAGAGAATTCGAATA CACGCGCGTANNNTGCATCAGGT | 5019 |
| TGCAGGACCAGAGAATTCGAATA CAGTCACCGGNNNTGCATCAGGT | 4540 | TGCAGGACCAGAGAATTCGAATA CACGTGCGACNNNTGCATCAGGT | 4780 | TGCAGGACCAGAGAATTCGAATA CACCGAGTGCNNNTGCATCAGGT | 5020 |
| TGCAGGACCAGAGAATTCGAATA CAAGAGCGATNNNTGCATCAGGT | 4541 | TGCAGGACCAGAGAATTCGAATA CAACGCTGGCNNNTGCATCAGGT | 4781 | TGCAGGACCAGAGAATTCGAATA CAGTTCAAGCNNNTGCATCAGGT | 5021 |
| TGCAGGACCAGAGAATTCGAATA CAATGGCTTGNNNTGCATCAGGT | 4542 | TGCAGGACCAGAGAATTCGAATA CAGAGATTCCNNNTGCATCAGGT | 4782 | TGCAGGACCAGAGAATTCGAATA CACAGCCCGANNNTGCATCAGGT | 5022 |
| TGCAGGACCAGAGAATTCGAATA CACCTGCAAANNNTGCATCAGGT | 4543 | TGCAGGACCAGAGAATTCGAATA CAGAGGACTANNNTGCATCAGGT | 4783 | TGCAGGACCAGAGAATTCGAATA CACCTTGACTNNNTGCATCAGGT | 5023 |
| TGCAGGACCAGAGAATTCGAATA CAGTCGAACTNNNTGCATCAGGT | 4544 | TGCAGGACCAGAGAATTCGAATA CATTGATTAGNNNTGCATCAGGT | 4784 | TGCAGGACCAGAGAATTCGAATA CAGACGCAAANNNTGCATCAGGT | 5024 |
| TGCAGGACCAGAGAATTCGAATA CATGTGGAGNNNTGCATCAGGT | 4545 | TGCAGGACCAGAGAATTCGAATA CACATGCATGNNNTGCATCAGGT | 4785 | TGCAGGACCAGAGAATTCGAATA CATGATCCTCNNNTGCATCAGGT | 5025 |
| TGCAGGACCAGAGAATTCGAATA CAAACGTGCTNNNTGCATCAGGT | 4546 | TGCAGGACCAGAGAATTCGAATA CATTGACCCNNNTGCATCAGGT | 4786 | TGCAGGACCAGAGAATTCGAATA CAAGAAATTGNNNTGCATCAGGT | 5026 |
| TGCAGGACCAGAGAATTCGAATA CAAAGATTGANNNTGCATCAGGT | 4547 | TGCAGGACCAGAGAATTCGAATA CAGGGCACTGNNNTGCATCAGGT | 4787 | TGCAGGACCAGAGAATTCGAATA CAGTCGTGGCNNNTGCATCAGGT | 5027 |
| TGCAGGACCAGAGAATTCGAATA CAACGTTATANNNTGCATCAGGT | 4548 | TGCAGGACCAGAGAATTCGAATA CATTCCTCTCNNNTGCATCAGGT | 4788 | TGCAGGACCAGAGAATTCGAATA CACATGTAGCNNNTGCATCAGGT | 5028 |
| TGCAGGACCAGAGAATTCGAATA CACCGCATAANNNTGCATCAGGT | 4549 | TGCAGGACCAGAGAATTCGAATA CAGCATTCAGNNNTGCATCAGGT | 4789 | TGCAGGACCAGAGAATTCGAATA CATAGCCCCNNNTGCATCAGGT | 5029 |
| TGCAGGACCAGAGAATTCGAATA CACGATTCCNNNTGCATCAGGT | 4550 | TGCAGGACCAGAGAATTCGAATA CAGTAACTTANNNTGCATCAGGT | 4790 | TGCAGGACCAGAGAATTCGAATA CAGTCTTGCTNNNTGCATCAGGT | 5030 |
| TGCAGGACCAGAGAATTCGAATA CAGTAAAACANNNTGCATCAGGT | 4551 | TGCAGGACCAGAGAATTCGAATA CAACTATGATNNNTGCATCAGGT | 4791 | TGCAGGACCAGAGAATTCGAATA CATGTAAGCCNNNTGCATCAGGT | 5031 |
| TGCAGGACCAGAGAATTCGAATA CAGGTGGTCCNNNTGCATCAGGT | 4552 | TGCAGGACCAGAGAATTCGAATA CAACTAAGAANNNTGCATCAGGT | 4792 | TGCAGGACCAGAGAATTCGAATA CAACAGAGACNNNTGCATCAGGT | 5032 |
| TGCAGGACCAGAGAATTCGAATA CAATGTCGTGNNNTGCATCAGGT | 4553 | TGCAGGACCAGAGAATTCGAATA CATAGGTTTANNNTGCATCAGGT | 4793 | TGCAGGACCAGAGAATTCGAATA CAAGTTCAGCNNNTGCATCAGGT | 5033 |
| TGCAGGACCAGAGAATTCGAATA CACGTAATATNNNTGCATCAGGT | 4554 | TGCAGGACCAGAGAATTCGAATA CACCTCGTCGNNNTGCATCAGGT | 4794 | TGCAGGACCAGAGAATTCGAATA CACCTGCTTANNNTGCATCAGGT | 5034 |
| TGCAGGACCAGAGAATTCGAATA CAACTCGCTTNNNTGCATCAGGT | 4555 | TGCAGGACCAGAGAATTCGAATA CAGGCTAGCCNNNTGCATCAGGT | 4795 | TGCAGGACCAGAGAATTCGAATA CAACACCTCNNNTGCATCAGGT | 5035 |
| TGCAGGACCAGAGAATTCGAATA CACCATACGANNNTGCATCAGGT | 4556 | TGCAGGACCAGAGAATTCGAATA CAGGGTTGANNNTGCATCAGGT | 4796 | TGCAGGACCAGAGAATTCGAATA CATATTGAACNNNTGCATCAGGT | 5036 |
| TGCAGGACCAGAGAATTCGAATA CACGGACAAANNNTGCATCAGGT | 4557 | TGCAGGACCAGAGAATTCGAATA CATAAAGCGNNNTGCATCAGGT | 4797 | TGCAGGACCAGAGAATTCGAATA CAGATTGGTCNNNTGCATCAGGT | 5037 |
| TGCAGGACCAGAGAATTCGAATA CACGCTGTTNNNTGCATCAGGT | 4558 | TGCAGGACCAGAGAATTCGAATA CAAATCTTTCNNNTGCATCAGGT | 4798 | TGCAGGACCAGAGAATTCGAATA CAAAAGAAAGNNNTGCATCAGGT | 5038 |
| TGCAGGACCAGAGAATTCGAATA CACTCCCATANNNTGCATCAGGT | 4559 | TGCAGGACCAGAGAATTCGAATA CACCAAGGAANNNTGCATCAGGT | 4799 | TGCAGGACCAGAGAATTCGAATA CATAAAAATANNNTGCATCAGGT | 5039 |

FIG. 18H

| Pool-19 | SEQ ID NO: | Pool-20 | SEQ ID NO: | Pool-21 | SEQ ID NO: |
|---|---|---|---|---|---|
| TGCAGGACCAGAGAATTCGAATA CAGGCTTGCGNNNTGCATCAGGT | 4560 | TGCAGGACCAGAGAATTCGAATA CAACAAAGTNNNTGCATCAGGT | 4800 | TGCAGGACCAGAGAATTCGAATA CATGTCCAGANNNTGCATCAGGT | 5040 |
| TGCAGGACCAGAGAATTCGAATA CAAAATTTCGNNNTGCATCAGGT | 4561 | TGCAGGACCAGAGAATTCGAATA CAGGCCCGGNNNTGCATCAGGT | 4801 | TGCAGGACCAGAGAATTCGAATA CATTTGAGGCNNNTGCATCAGGT | 5041 |
| TGCAGGACCAGAGAATTCGAATA CATACCTAGGNNNTGCATCAGGT | 4562 | TGCAGGACCAGAGAATTCGAATA CAAACATGCCNNNTGCATCAGGT | 4802 | TGCAGGACCAGAGAATTCGAATA CACCATCCTANNNTGCATCAGGT | 5042 |
| TGCAGGACCAGAGAATTCGAATA CACACGCACGNNNTGCATCAGGT | 4563 | TGCAGGACCAGAGAATTCGAATA CATGGAGTTNNNTGCATCAGGT | 4803 | TGCAGGACCAGAGAATTCGAATA CACTCCAGAANNNTGCATCAGGT | 5043 |
| TGCAGGACCAGAGAATTCGAATA CACATTGCAGNNNTGCATCAGGT | 4564 | TGCAGGACCAGAGAATTCGAATA CATAGCGGAANNNTGCATCAGGT | 4804 | TGCAGGACCAGAGAATTCGAATA CACAGATGGANNNTGCATCAGGT | 5044 |
| TGCAGGACCAGAGAATTCGAATA CAGGCATTAATNNNTGCATCAGGT | 4565 | TGCAGGACCAGAGAATTCGAATA CAGTCTACTCNNNTGCATCAGGT | 4805 | TGCAGGACCAGAGAATTCGAATA CATAATCCCNNNTGCATCAGGT | 5045 |
| TGCAGGACCAGAGAATTCGAATA CAAGACGCCNNNTGCATCAGGT | 4566 | TGCAGGACCAGAGAATTCGAATA CATTTGACCCNNNTGCATCAGGT | 4806 | TGCAGGACCAGAGAATTCGAATA CAAGGCGCTCNNNTGCATCAGGT | 5046 |
| TGCAGGACCAGAGAATTCGAATA CACACACGATNNNTGCATCAGGT | 4567 | TGCAGGACCAGAGAATTCGAATA CAAAGGAGAGNNNTGCATCAGGT | 4807 | TGCAGGACCAGAGAATTCGAATA CAATTGTCAANNNTGCATCAGGT | 5047 |
| TGCAGGACCAGAGAATTCGAATA CATGATTGTANNNTGCATCAGGT | 4568 | TGCAGGACCAGAGAATTCGAATA CATTTCGCCANNNTGCATCAGGT | 4808 | TGCAGGACCAGAGAATTCGAATA CACGCGTTAANNNTGCATCAGGT | 5048 |

FIG. 19A

| Pool-22 | SEQ ID NO: | Pool-23 | SEQ ID NO: | Pool-24 | SEQ ID NO: |
|---|---|---|---|---|---|
| TGCAGGACCAGAGAATTCGAATA CATTGATGCGNNNACGTATGCCA | 5049 | TGCAGGACCAGAGAATTCGAATA CATAACTAACNNNACGTATGCCA | 5289 | TGCAGGACCAGAGAATTCGAATA CAGTTGCGCGNNNACGTATGCCA | 5529 |
| TGCAGGACCAGAGAATTCGAATA CACCCTACGCNNNACGTATGCCA | 5050 | TGCAGGACCAGAGAATTCGAATA CAAAACTCGCNNNACGTATGCCA | 5290 | TGCAGGACCAGAGAATTCGAATA CAGGAACATGNNNACGTATGCCA | 5530 |
| TGCAGGACCAGAGAATTCGAATA CAGCGGCGAANNNACGTATGCCA | 5051 | TGCAGGACCAGAGAATTCGAATA CATGAGTTGCNNNACGTATGCCA | 5291 | TGCAGGACCAGAGAATTCGAATA CACGGTAACTNNNACGTATGCCA | 5531 |
| TGCAGGACCAGAGAATTCGAATA CATAGCCGCGNNNACGTATGCCA | 5052 | TGCAGGACCAGAGAATTCGAATA CAACAACAAANNNACGTATGCCA | 5292 | TGCAGGACCAGAGAATTCGAATA CAATGTGTGCNNNACGTATGCCA | 5532 |
| TGCAGGACCAGAGAATTCGAATA CAGAAGCGATNNNACGTATGCCA | 5053 | TGCAGGACCAGAGAATTCGAATA CAGCCCTACCNNNACGTATGCCA | 5293 | TGCAGGACCAGAGAATTCGAATA CACGGAGTTGNNNACGTATGCCA | 5533 |
| TGCAGGACCAGAGAATTCGAATA CAGACAGTGANNNACGTATGCCA | 5054 | TGCAGGACCAGAGAATTCGAATA CAGTTGAGAGNNNACGTATGCCA | 5294 | TGCAGGACCAGAGAATTCGAATA CATGAACTCGNNNACGTATGCCA | 5534 |
| TGCAGGACCAGAGAATTCGAATA CACTTTATCANNNACGTATGCCA | 5055 | TGCAGGACCAGAGAATTCGAATA CACACTGACTNNNACGTATGCCA | 5295 | TGCAGGACCAGAGAATTCGAATA CAACATCGCANNNACGTATGCCA | 5535 |
| TGCAGGACCAGAGAATTCGAATA CACAGGAAGTNNNACGTATGCCA | 5056 | TGCAGGACCAGAGAATTCGAATA CATGAAGACGNNNACGTATGCCA | 5296 | TGCAGGACCAGAGAATTCGAATA CAGAATTGTTNNNACGTATGCCA | 5536 |
| TGCAGGACCAGAGAATTCGAATA CAGTATTGGCNNNACGTATGCCA | 5057 | TGCAGGACCAGAGAATTCGAATA CACCCTATGTNNNACGTATGCCA | 5297 | TGCAGGACCAGAGAATTCGAATA CAAAACACTTNNNACGTATGCCA | 5537 |
| TGCAGGACCAGAGAATTCGAATA CATCAGCCGGNNNACGTATGCCA | 5058 | TGCAGGACCAGAGAATTCGAATA CATGGTTTGGNNNACGTATGCCA | 5298 | TGCAGGACCAGAGAATTCGAATA CATGTTTGCCNNNACGTATGCCA | 5538 |
| TGCAGGACCAGAGAATTCGAATA CAAGCAGGATNNNACGTATGCCA | 5059 | TGCAGGACCAGAGAATTCGAATA CAGCACTCGCNNNACGTATGCCA | 5299 | TGCAGGACCAGAGAATTCGAATA CACGGCGTGCANNNACGTATGCCA | 5539 |
| TGCAGGACCAGAGAATTCGAATA CAGTTAGTGCNNNACGTATGCCA | 5060 | TGCAGGACCAGAGAATTCGAATA CAAAAGAGTTNNNACGTATGCCA | 5300 | TGCAGGACCAGAGAATTCGAATA CAGTAATGCCNNNACGTATGCCA | 5540 |
| TGCAGGACCAGAGAATTCGAATA CAATTGTAGTNNNACGTATGCCA | 5061 | TGCAGGACCAGAGAATTCGAATA CAGTTCGTGANNNACGTATGCCA | 5301 | TGCAGGACCAGAGAATTCGAATA CAGTTCAGACNNNACGTATGCCA | 5541 |
| TGCAGGACCAGAGAATTCGAATA CAAGCACGTTNNNACGTATGCCA | 5062 | TGCAGGACCAGAGAATTCGAATA CATCCCCACGNNNACGTATGCCA | 5302 | TGCAGGACCAGAGAATTCGAATA CATAATCAGTNNNACGTATGCCA | 5542 |
| TGCAGGACCAGAGAATTCGAATA CACCCCGGTTNNNACGTATGCCA | 5063 | TGCAGGACCAGAGAATTCGAATA CAAAATTCTGNNNACGTATGCCA | 5303 | TGCAGGACCAGAGAATTCGAATA CATTCCCAACNNNACGTATGCCA | 5543 |
| TGCAGGACCAGAGAATTCGAATA CAATATCTCTNNNACGTATGCCA | 5064 | TGCAGGACCAGAGAATTCGAATA CATCCACAGANNNACGTATGCCA | 5304 | TGCAGGACCAGAGAATTCGAATA CACTAGTAGCNNNACGTATGCCA | 5544 |
| TGCAGGACCAGAGAATTCGAATA CAATCTTCATNNNACGTATGCCA | 5065 | TGCAGGACCAGAGAATTCGAATA CAAGAGTTTTNNNACGTATGCCA | 5305 | TGCAGGACCAGAGAATTCGAATA CATTAATACGNNNACGTATGCCA | 5545 |
| TGCAGGACCAGAGAATTCGAATA CAGGTACTCANNNACGTATGCCA | 5066 | TGCAGGACCAGAGAATTCGAATA CATGGAGCGGNNNACGTATGCCA | 5306 | TGCAGGACCAGAGAATTCGAATA CATACAGAGGNNNACGTATGCCA | 5546 |
| TGCAGGACCAGAGAATTCGAATA CACCCACCTATNNNACGTATGCCA | 5067 | TGCAGGACCAGAGAATTCGAATA CACTTTAATCNNNACGTATGCCA | 5307 | TGCAGGACCAGAGAATTCGAATA CACGGACACANNNACGTATGCCA | 5547 |
| TGCAGGACCAGAGAATTCGAATA CAATAATAAANNNACGTATGCCA | 5068 | TGCAGGACCAGAGAATTCGAATA CAACGTCAGTNNNACGTATGCCA | 5308 | TGCAGGACCAGAGAATTCGAATA CATCTCCCANNNACGTATGCCA | 5548 |
| TGCAGGACCAGAGAATTCGAATA CAACATAATCNNNACGTATGCCA | 5069 | TGCAGGACCAGAGAATTCGAATA CATGGAGCTTNNNACGTATGCCA | 5309 | TGCAGGACCAGAGAATTCGAATA CAGTACTCANNNACGTATGCCA | 5549 |
| TGCAGGACCAGAGAATTCGAATA CACGTTCGTANNNACGTATGCCA | 5070 | TGCAGGACCAGAGAATTCGAATA CAGCACACCGNNNACGTATGCCA | 5310 | TGCAGGACCAGAGAATTCGAATA CAGTAGTACCNNNACGTATGCCA | 5550 |
| TGCAGGACCAGAGAATTCGAATA CAGGATCTTGNNNACGTATGCCA | 5071 | TGCAGGACCAGAGAATTCGAATA CATTTGCTGCNNNACGTATGCCA | 5311 | TGCAGGACCAGAGAATTCGAATA CATAACGTCGNNNACGTATGCCA | 5551 |
| TGCAGGACCAGAGAATTCGAATA CAGAGGCGGTNNNACGTATGCCA | 5072 | TGCAGGACCAGAGAATTCGAATA CACAGCGAAANNNACGTATGCCA | 5312 | TGCAGGACCAGAGAATTCGAATA CACGGATAGANNNACGTATGCCA | 5552 |
| TGCAGGACCAGAGAATTCGAATA CACTCAAAATNNNACGTATGCCA | 5073 | TGCAGGACCAGAGAATTCGAATA CAACGATTGCNNNACGTATGCCA | 5313 | TGCAGGACCAGAGAATTCGAATA CAGGAATAGCNNNACGTATGCCA | 5553 |
| TGCAGGACCAGAGAATTCGAATA CACAACTGCANNNACGTATGCCA | 5074 | TGCAGGACCAGAGAATTCGAATA CATAGCGTTGNNNACGTATGCCA | 5314 | TGCAGGACCAGAGAATTCGAATA CAGGAGTCAANNNACGTATGCCA | 5554 |
| TGCAGGACCAGAGAATTCGAATA CACGGTTCCCNNNACGTATGCCA | 5075 | TGCAGGACCAGAGAATTCGAATA CAACGCTGCGNNNACGTATGCCA | 5315 | TGCAGGACCAGAGAATTCGAATA CAATTAGCTANNNACGTATGCCA | 5555 |
| TGCAGGACCAGAGAATTCGAATA CAGTGGTAGANNNACGTATGCCA | 5076 | TGCAGGACCAGAGAATTCGAATA CACTTTATTGNNNACGTATGCCA | 5316 | TGCAGGACCAGAGAATTCGAATA CAAGACATTNNNACGTATGCCA | 5556 |
| TGCAGGACCAGAGAATTCGAATA CATCTGAGTGNNNACGTATGCCA | 5077 | TGCAGGACCAGAGAATTCGAATA CAGCGAAATNNNACGTATGCCA | 5317 | TGCAGGACCAGAGAATTCGAATA CATCTACGCTNNNACGTATGCCA | 5557 |
| TGCAGGACCAGAGAATTCGAATA CACAGCCTTTNNNACGTATGCCA | 5078 | TGCAGGACCAGAGAATTCGAATA CATTTATTGCNNNACGTATGCCA | 5318 | TGCAGGACCAGAGAATTCGAATA CATGCCTTCANNNACGTATGCCA | 5558 |
| TGCAGGACCAGAGAATTCGAATA CAGTGTGTTGNNNACGTATGCCA | 5079 | TGCAGGACCAGAGAATTCGAATA CATCCAGCTGNNNACGTATGCCA | 5319 | TGCAGGACCAGAGAATTCGAATA CAAGATCACCNNNACGTATGCCA | 5559 |
| TGCAGGACCAGAGAATTCGAATA CAATTGTAACNNNACGTATGCCA | 5080 | TGCAGGACCAGAGAATTCGAATA CACCCATGCCNNNACGTATGCCA | 5320 | TGCAGGACCAGAGAATTCGAATA CAATCCTTTANNNACGTATGCCA | 5560 |
| TGCAGGACCAGAGAATTCGAATA CAAAGTTCATNNNACGTATGCCA | 5081 | TGCAGGACCAGAGAATTCGAATA CAATGCTGGTNNNACGTATGCCA | 5321 | TGCAGGACCAGAGAATTCGAATA CAGTAGTTCGNNNACGTATGCCA | 5561 |

FIG. 19B

| Pool-22 | SEQ ID NO: | Pool-23 | SEQ ID NO: | Pool-24 | SEQ ID NO: |
|---|---|---|---|---|---|
| TGCAGGACCAGAGAATTCGAATA CAAAGTCGCTNNNACGTATGCCA | 5082 | TGCAGGACCAGAGAATTCGAATA CAAATGGCCTNNNACGTATGCCA | 5322 | TGCAGGACCAGAGAATTCGAATA CAGGGCCGGCNNNACGTATGCCA | 5562 |
| TGCAGGACCAGAGAATTCGAATA CAATATCAGTNNNACGTATGCCA | 5083 | TGCAGGACCAGAGAATTCGAATA CAGGTTTAGCNNNACGTATGCCA | 5323 | TGCAGGACCAGAGAATTCGAATA CAAGGCCAGGNNNACGTATGCCA | 5563 |
| TGCAGGACCAGAGAATTCGAATA CATTCTCCGANNNACGTATGCCA | 5084 | TGCAGGACCAGAGAATTCGAATA CATTCCCAGTNNNACGTATGCCA | 5324 | TGCAGGACCAGAGAATTCGAATA CATTGTCAGGNNNACGTATGCCA | 5564 |
| TGCAGGACCAGAGAATTCGAATA CATCTTGAAANNNACGTATGCCA | 5085 | TGCAGGACCAGAGAATTCGAATA CAAGCGATGANNNACGTATGCCA | 5325 | TGCAGGACCAGAGAATTCGAATA CAAAATCTGTNNNACGTATGCCA | 5565 |
| TGCAGGACCAGAGAATTCGAATA CATTACCGAGNNNACGTATGCCA | 5086 | TGCAGGACCAGAGAATTCGAATA CACCGGTCAGNNNACGTATGCCA | 5326 | TGCAGGACCAGAGAATTCGAATA CAATAAAAATNNNACGTATGCCA | 5566 |
| TGCAGGACCAGAGAATTCGAATA CAACTTAGATNNNACGTATGCCA | 5087 | TGCAGGACCAGAGAATTCGAATA CAAGTATACTNNNACGTATGCCA | 5327 | TGCAGGACCAGAGAATTCGAATA CATGTCACAGNNNACGTATGCCA | 5567 |
| TGCAGGACCAGAGAATTCGAATA CACATCGGTANNNACGTATGCCA | 5088 | TGCAGGACCAGAGAATTCGAATA CAGACTGAGANNNACGTATGCCA | 5328 | TGCAGGACCAGAGAATTCGAATA CATCTCATGCNNNACGTATGCCA | 5568 |
| TGCAGGACCAGAGAATTCGAATA CACCAGCGCANNNACGTATGCCA | 5089 | TGCAGGACCAGAGAATTCGAATA CATCACGTTCNNNACGTATGCCA | 5329 | TGCAGGACCAGAGAATTCGAATA CAGAACGCTNNNACGTATGCCA | 5569 |
| TGCAGGACCAGAGAATTCGAATA CATATCGATANNNACGTATGCCA | 5090 | TGCAGGACCAGAGAATTCGAATA CACTCACTACNNNACGTATGCCA | 5330 | TGCAGGACCAGAGAATTCGAATA CATCTCAGCTNNNACGTATGCCA | 5570 |
| TGCAGGACCAGAGAATTCGAATA CAAGACTCTGNNNACGTATGCCA | 5091 | TGCAGGACCAGAGAATTCGAATA CAGAAGGAGANNNACGTATGCCA | 5331 | TGCAGGACCAGAGAATTCGAATA CAGATGCGAANNNACGTATGCCA | 5571 |
| TGCAGGACCAGAGAATTCGAATA CAAGAGCACANNNACGTATGCCA | 5092 | TGCAGGACCAGAGAATTCGAATA CACCCTGCACNNNACGTATGCCA | 5332 | TGCAGGACCAGAGAATTCGAATA CACTCTATCGNNNACGTATGCCA | 5572 |
| TGCAGGACCAGAGAATTCGAATA CATACCGTAGNNNACGTATGCCA | 5093 | TGCAGGACCAGAGAATTCGAATA CAGCAACGAANNNACGTATGCCA | 5333 | TGCAGGACCAGAGAATTCGAATA CAGACGGTAANNNACGTATGCCA | 5573 |
| TGCAGGACCAGAGAATTCGAATA CAGAAGGTGTNNNACGTATGCCA | 5094 | TGCAGGACCAGAGAATTCGAATA CAGCTACCTTNNNACGTATGCCA | 5334 | TGCAGGACCAGAGAATTCGAATA CATATATTTNNNACGTATGCCA | 5574 |
| TGCAGGACCAGAGAATTCGAATA CATTGGACCANNNACGTATGCCA | 5095 | TGCAGGACCAGAGAATTCGAATA CAACACCTTCNNNACGTATGCCA | 5335 | TGCAGGACCAGAGAATTCGAATA CATGCATTCCNNNACGTATGCCA | 5575 |
| TGCAGGACCAGAGAATTCGAATA CAGCAATCACNNNACGTATGCCA | 5096 | TGCAGGACCAGAGAATTCGAATA CACTGTTAAANNNACGTATGCCA | 5336 | TGCAGGACCAGAGAATTCGAATA CATATATCTCNNNACGTATGCCA | 5576 |
| TGCAGGACCAGAGAATTCGAATA CATTGAGCGTNNNACGTATGCCA | 5097 | TGCAGGACCAGAGAATTCGAATA CAATCTCGGANNNACGTATGCCA | 5337 | TGCAGGACCAGAGAATTCGAATA CACCGGCTGANNNACGTATGCCA | 5577 |
| TGCAGGACCAGAGAATTCGAATA CACAAGTGTCNNNACGTATGCCA | 5098 | TGCAGGACCAGAGAATTCGAATA CAATGTTGCGNNNACGTATGCCA | 5338 | TGCAGGACCAGAGAATTCGAATA CAGAATCAGGNNNACGTATGCCA | 5578 |
| TGCAGGACCAGAGAATTCGAATA CAGTCTAATANNNACGTATGCCA | 5099 | TGCAGGACCAGAGAATTCGAATA CAGCACATGTNNNACGTATGCCA | 5339 | TGCAGGACCAGAGAATTCGAATA CATCCTAGAGNNNACGTATGCCA | 5579 |
| TGCAGGACCAGAGAATTCGAATA CAAAGAAATCNNNACGTATGCCA | 5100 | TGCAGGACCAGAGAATTCGAATA CAAATCCGGTNNNACGTATGCCA | 5340 | TGCAGGACCAGAGAATTCGAATA CACCGTGTGGNNNACGTATGCCA | 5580 |
| TGCAGGACCAGAGAATTCGAATA CAGCTAGATCNNNACGTATGCCA | 5101 | TGCAGGACCAGAGAATTCGAATA CACTATTTACNNNACGTATGCCA | 5341 | TGCAGGACCAGAGAATTCGAATA CATAGTTTCTNNNACGTATGCCA | 5581 |
| TGCAGGACCAGAGAATTCGAATA CAGATAAGTANNNACGTATGCCA | 5102 | TGCAGGACCAGAGAATTCGAATA CACGTGCCAGNNNACGTATGCCA | 5342 | TGCAGGACCAGAGAATTCGAATA CAGATAACGANNNACGTATGCCA | 5582 |
| TGCAGGACCAGAGAATTCGAATA CAGGTTCAGTNNNACGTATGCCA | 5103 | TGCAGGACCAGAGAATTCGAATA CACCGGTAGCNNNACGTATGCCA | 5343 | TGCAGGACCAGAGAATTCGAATA CACTCGTACTNNNACGTATGCCA | 5583 |
| TGCAGGACCAGAGAATTCGAATA CAAGCTGACTNNNACGTATGCCA | 5104 | TGCAGGACCAGAGAATTCGAATA CAACATATGTNNNACGTATGCCA | 5344 | TGCAGGACCAGAGAATTCGAATA CAGCACTTTCNNNACGTATGCCA | 5584 |
| TGCAGGACCAGAGAATTCGAATA CATGCGCCAGNNNACGTATGCCA | 5105 | TGCAGGACCAGAGAATTCGAATA CATGGTGGCCNNNACGTATGCCA | 5345 | TGCAGGACCAGAGAATTCGAATA CAGTTCTCGTNNNACGTATGCCA | 5585 |
| TGCAGGACCAGAGAATTCGAATA CATGTCAGTGNNNACGTATGCCA | 5106 | TGCAGGACCAGAGAATTCGAATA CACAACTCAGNNNACGTATGCCA | 5346 | TGCAGGACCAGAGAATTCGAATA CACTTACGTCNNNACGTATGCCA | 5586 |
| TGCAGGACCAGAGAATTCGAATA CAGAATCGTCNNNACGTATGCCA | 5107 | TGCAGGACCAGAGAATTCGAATA CACCAATTTNNNACGTATGCCA | 5347 | TGCAGGACCAGAGAATTCGAATA CACAGAAGACNNNACGTATGCCA | 5587 |
| TGCAGGACCAGAGAATTCGAATA CACCCCATGCNNNACGTATGCCA | 5108 | TGCAGGACCAGAGAATTCGAATA CAAACTGAGGNNNACGTATGCCA | 5348 | TGCAGGACCAGAGAATTCGAATA CATAAGTCTANNNACGTATGCCA | 5588 |
| TGCAGGACCAGAGAATTCGAATA CACATTAGCGNNNCTAGCGTTAC | 5109 | TGCAGGACCAGAGAATTCGAATA CAACCTAGTCNNNCTAGCGTTAC | 5349 | TGCAGGACCAGAGAATTCGAATA CACATACTAANNNCTAGCGTTAC | 5589 |
| TGCAGGACCAGAGAATTCGAATA CAATCCACCTNNNCTAGCGTTAC | 5110 | TGCAGGACCAGAGAATTCGAATA CAGCATGGCCNNNCTAGCGTTAC | 5350 | TGCAGGACCAGAGAATTCGAATA CACCGAATCANNNCTAGCGTTAC | 5590 |
| TGCAGGACCAGAGAATTCGAATA CAACATGCGTNNNCTAGCGTTAC | 5111 | TGCAGGACCAGAGAATTCGAATA CAAGTCAGAANNNCTAGCGTTAC | 5351 | TGCAGGACCAGAGAATTCGAATA CACTATTTGNNNCTAGCGTTAC | 5591 |
| TGCAGGACCAGAGAATTCGAATA CAGCTTTACCNNNCTAGCGTTAC | 5112 | TGCAGGACCAGAGAATTCGAATA CATGAATACTNNNCTAGCGTTAC | 5352 | TGCAGGACCAGAGAATTCGAATA CACCCGACAGNNNCTAGCGTTAC | 5592 |
| TGCAGGACCAGAGAATTCGAATA CAAACCTCCTNNNCTAGCGTTAC | 5113 | TGCAGGACCAGAGAATTCGAATA CAGTATGAGCNNNCTAGCGTTAC | 5353 | TGCAGGACCAGAGAATTCGAATA CAACTTCGAGNNNCTAGCGTTAC | 5593 |
| TGCAGGACCAGAGAATTCGAATA CACTTTATGTNNNCTAGCGTTAC | 5114 | TGCAGGACCAGAGAATTCGAATA CAGACTTGTGNNNCTAGCGTTAC | 5354 | TGCAGGACCAGAGAATTCGAATA CATGATGCTGNNNCTAGCGTTAC | 5594 |

FIG. 19C

| Pool-22 | SEQ ID NO: | Pool-23 | SEQ ID NO: | Pool-24 | SEQ ID NO: |
|---|---|---|---|---|---|
| TGCAGGACCAGAGAATTCGAATA CACTCGCCTGNNNCTAGCGTTAC | 5115 | TGCAGGACCAGAGAATTCGAATA CAAATTAAGGNNNCTAGCGTTAC | 5355 | TGCAGGACCAGAGAATTCGAATA CAGCGCAGGANNNCTAGCGTTAC | 5595 |
| TGCAGGACCAGAGAATTCGAATA CAATGATGTTNNNCTAGCGTTAC | 5116 | TGCAGGACCAGAGAATTCGAATA CACGGTTGTANNNCTAGCGTTAC | 5356 | TGCAGGACCAGAGAATTCGAATA CATTCACAAANNNCTAGCGTTAC | 5596 |
| TGCAGGACCAGAGAATTCGAATA CAGAGTTGGANNNCTAGCGTTAC | 5117 | TGCAGGACCAGAGAATTCGAATA CACCTGTCCGNNNCTAGCGTTAC | 5357 | TGCAGGACCAGAGAATTCGAATA CAATGCACTGNNNCTAGCGTTAC | 5597 |
| TGCAGGACCAGAGAATTCGAATA CAACAACCACNNNCTAGCGTTAC | 5118 | TGCAGGACCAGAGAATTCGAATA CAGTGACGCCNNNCTAGCGTTAC | 5358 | TGCAGGACCAGAGAATTCGAATA CAGTTGCCGGNNNCTAGCGTTAC | 5598 |
| TGCAGGACCAGAGAATTCGAATA CATACCGCAANNNCTAGCGTTAC | 5119 | TGCAGGACCAGAGAATTCGAATA CAGTGTTGCANNNCTAGCGTTAC | 5359 | TGCAGGACCAGAGAATTCGAATA CAATTTTCCANNNCTAGCGTTAC | 5599 |
| TGCAGGACCAGAGAATTCGAATA CAGGTTAAAANNNCTAGCGTTAC | 5120 | TGCAGGACCAGAGAATTCGAATA CACCCGATTTNNNCTAGCGTTAC | 5360 | TGCAGGACCAGAGAATTCGAATA CACCAGCAGCNNNCTAGCGTTAC | 5600 |
| TGCAGGACCAGAGAATTCGAATA CACGGAAAGTNNNCTAGCGTTAC | 5121 | TGCAGGACCAGAGAATTCGAATA CATTTCCGTGNNNCTAGCGTTAC | 5361 | TGCAGGACCAGAGAATTCGAATA CACGGACAGGNNNCTAGCGTTAC | 5601 |
| TGCAGGACCAGAGAATTCGAATA CAGTGGTCGNNNCTAGCGTTAC | 5122 | TGCAGGACCAGAGAATTCGAATA CAAAGGTCCTNNNCTAGCGTTAC | 5362 | TGCAGGACCAGAGAATTCGAATA CATCTGCGTTNNNCTAGCGTTAC | 5602 |
| TGCAGGACCAGAGAATTCGAATA CAGGTGTCCGNNNCTAGCGTTAC | 5123 | TGCAGGACCAGAGAATTCGAATA CAGAGCCAAANNNCTAGCGTTAC | 5363 | TGCAGGACCAGAGAATTCGAATA CATTTGCTATNNNCTAGCGTTAC | 5603 |
| TGCAGGACCAGAGAATTCGAATA CATCGCACTTNNNCTAGCGTTAC | 5124 | TGCAGGACCAGAGAATTCGAATA CACCCTTCAANNNCTAGCGTTAC | 5364 | TGCAGGACCAGAGAATTCGAATA CATTTCCTTTNNNCTAGCGTTAC | 5604 |
| TGCAGGACCAGAGAATTCGAATA CATTCGGTCTNNNCTAGCGTTAC | 5125 | TGCAGGACCAGAGAATTCGAATA CAGCGCGGTTNNNCTAGCGTTAC | 5365 | TGCAGGACCAGAGAATTCGAATA CACGAGACTTNNNCTAGCGTTAC | 5605 |
| TGCAGGACCAGAGAATTCGAATA CAACGAGGATNNNCTAGCGTTAC | 5126 | TGCAGGACCAGAGAATTCGAATA CACTTCTAGCNNNCTAGCGTTAC | 5366 | TGCAGGACCAGAGAATTCGAATA CAAACTAGAANNNCTAGCGTTAC | 5606 |
| TGCAGGACCAGAGAATTCGAATA CAGTAGATGGNNNCTAGCGTTAC | 5127 | TGCAGGACCAGAGAATTCGAATA CAGTGTAAAANNNCTAGCGTTAC | 5367 | TGCAGGACCAGAGAATTCGAATA CACCTCGATTNNNCTAGCGTTAC | 5607 |
| TGCAGGACCAGAGAATTCGAATA CACCACACTTNNNCTAGCGTTAC | 5128 | TGCAGGACCAGAGAATTCGAATA CAACTATGCGNNNCTAGCGTTAC | 5368 | TGCAGGACCAGAGAATTCGAATA CAGTGAAGACNNNCTAGCGTTAC | 5608 |
| TGCAGGACCAGAGAATTCGAATA CAGTTTGCGANNNCTAGCGTTAC | 5129 | TGCAGGACCAGAGAATTCGAATA CACGCCAGACNNNCTAGCGTTAC | 5369 | TGCAGGACCAGAGAATTCGAATA CAACGTTACGNNNCTAGCGTTAC | 5609 |
| TGCAGGACCAGAGAATTCGAATA CAACGGTATCNNNCTAGCGTTAC | 5130 | TGCAGGACCAGAGAATTCGAATA CAATCAGTGCNNNCTAGCGTTAC | 5370 | TGCAGGACCAGAGAATTCGAATA CACGTCCTGCNNNCTAGCGTTAC | 5610 |
| TGCAGGACCAGAGAATTCGAATA CAATGATAGANNNCTAGCGTTAC | 5131 | TGCAGGACCAGAGAATTCGAATA CAGTTCTACCNNNCTAGCGTTAC | 5371 | TGCAGGACCAGAGAATTCGAATA CAACTCCTACNNNCTAGCGTTAC | 5611 |
| TGCAGGACCAGAGAATTCGAATA CACAATAACTNNNCTAGCGTTAC | 5132 | TGCAGGACCAGAGAATTCGAATA CACACCATAGNNNCTAGCGTTAC | 5372 | TGCAGGACCAGAGAATTCGAATA CAGTTAGGTCNNNCTAGCGTTAC | 5612 |
| TGCAGGACCAGAGAATTCGAATA CAGATCCTAGNNNCTAGCGTTAC | 5133 | TGCAGGACCAGAGAATTCGAATA CACAAAGATANNNCTAGCGTTAC | 5373 | TGCAGGACCAGAGAATTCGAATA CACTCATGAGNNNCTAGCGTTAC | 5613 |
| TGCAGGACCAGAGAATTCGAATA CAATTACCCCNNNCTAGCGTTAC | 5134 | TGCAGGACCAGAGAATTCGAATA CACAGGGCTTNNNCTAGCGTTAC | 5374 | TGCAGGACCAGAGAATTCGAATA CATATTTACCNNNCTAGCGTTAC | 5614 |
| TGCAGGACCAGAGAATTCGAATA CACTGTGCGGNNNCTAGCGTTAC | 5135 | TGCAGGACCAGAGAATTCGAATA CAGTCGTTAGNNNCTAGCGTTAC | 5375 | TGCAGGACCAGAGAATTCGAATA CACCCTTCATNNNCTAGCGTTAC | 5615 |
| TGCAGGACCAGAGAATTCGAATA CATATGTGTANNNCTAGCGTTAC | 5136 | TGCAGGACCAGAGAATTCGAATA CAAACGTTCGNNNCTAGCGTTAC | 5376 | TGCAGGACCAGAGAATTCGAATA CAGGACTAGANNNCTAGCGTTAC | 5616 |
| TGCAGGACCAGAGAATTCGAATA CAGCTCCTTANNNCTAGCGTTAC | 5137 | TGCAGGACCAGAGAATTCGAATA CAATGGCTGTNNNCTAGCGTTAC | 5377 | TGCAGGACCAGAGAATTCGAATA CAGTGGCAAANNNCTAGCGTTAC | 5617 |
| TGCAGGACCAGAGAATTCGAATA CAAAAAGCGCNNNCTAGCGTTAC | 5138 | TGCAGGACCAGAGAATTCGAATA CAATTCTATCNNNCTAGCGTTAC | 5378 | TGCAGGACCAGAGAATTCGAATA CAAATAAACGNNNCTAGCGTTAC | 5618 |
| TGCAGGACCAGAGAATTCGAATA CATGGTATATNNNCTAGCGTTAC | 5139 | TGCAGGACCAGAGAATTCGAATA CAGGTAGCAANNNCTAGCGTTAC | 5379 | TGCAGGACCAGAGAATTCGAATA CAGTATACCGNNNCTAGCGTTAC | 5619 |
| TGCAGGACCAGAGAATTCGAATA CACATCACGANNNCTAGCGTTAC | 5140 | TGCAGGACCAGAGAATTCGAATA CATGGTGACTNNNCTAGCGTTAC | 5380 | TGCAGGACCAGAGAATTCGAATA CACCAAATTANNNCTAGCGTTAC | 5620 |
| TGCAGGACCAGAGAATTCGAATA CACTCATTCGNNNCTAGCGTTAC | 5141 | TGCAGGACCAGAGAATTCGAATA CATCCTAATTNNNCTAGCGTTAC | 5381 | TGCAGGACCAGAGAATTCGAATA CATTCTTTAGNNNCTAGCGTTAC | 5621 |
| TGCAGGACCAGAGAATTCGAATA CAGGCGCATCNNNCTAGCGTTAC | 5142 | TGCAGGACCAGAGAATTCGAATA CAGCCGCCTGNNNCTAGCGTTAC | 5382 | TGCAGGACCAGAGAATTCGAATA CATGTTCGTCNNNCTAGCGTTAC | 5622 |
| TGCAGGACCAGAGAATTCGAATA CAAAAGATTGNNNCTAGCGTTAC | 5143 | TGCAGGACCAGAGAATTCGAATA CACCCGCAAGNNNCTAGCGTTAC | 5383 | TGCAGGACCAGAGAATTCGAATA CACCGGCTCTNNNCTAGCGTTAC | 5623 |
| TGCAGGACCAGAGAATTCGAATA CATGAAAGATNNNCTAGCGTTAC | 5144 | TGCAGGACCAGAGAATTCGAATA CATCCCTGGCNNNCTAGCGTTAC | 5384 | TGCAGGACCAGAGAATTCGAATA CACGAGTGTTNNNCTAGCGTTAC | 5624 |
| TGCAGGACCAGAGAATTCGAATA CACAGGCTTANNNCTAGCGTTAC | 5145 | TGCAGGACCAGAGAATTCGAATA CAGATCCCTTNNNCTAGCGTTAC | 5385 | TGCAGGACCAGAGAATTCGAATA CAGGGTATNNNCTAGCGTTAC | 5625 |
| TGCAGGACCAGAGAATTCGAATA CACGAATTCGNNNCTAGCGTTAC | 5146 | TGCAGGACCAGAGAATTCGAATA CATAGATGAANNNCTAGCGTTAC | 5386 | TGCAGGACCAGAGAATTCGAATA CAAAGTCTCGNNNCTAGCGTTAC | 5626 |
| TGCAGGACCAGAGAATTCGAATA CATAACCACGNNNCTAGCGTTAC | 5147 | TGCAGGACCAGAGAATTCGAATA CAAGGCAAGTNNNCTAGCGTTAC | 5387 | TGCAGGACCAGAGAATTCGAATA CAGTAGCAAGNNNCTAGCGTTAC | 5627 |

FIG. 19D

| Pool-22 | SEQ ID NO: | Pool-23 | SEQ ID NO: | Pool-24 | SEQ ID NO: |
|---|---|---|---|---|---|
| TGCAGGACCAGAGAATTCGAATA CAAGCAGGTANNNCTAGCGTTAC | 5148 | TGCAGGACCAGAGAATTCGAATA CATAATCTGANNNCTAGCGTTAC | 5388 | TGCAGGACCAGAGAATTCGAATA CACGGAGAGCNNNCTAGCGTTAC | 5628 |
| TGCAGGACCAGAGAATTCGAATA CACACAAGGANNNCTAGCGTTAC | 5149 | TGCAGGACCAGAGAATTCGAATA CAGGCCAAAANNNCTAGCGTTAC | 5389 | TGCAGGACCAGAGAATTCGAATA CAGCTTTTGCNNNCTAGCGTTAC | 5629 |
| TGCAGGACCAGAGAATTCGAATA CAACTAGCCAMNNCTAGCGTTAC | 5150 | TGCAGGACCAGAGAATTCGAATA CAAAGCGTCTNNNCTAGCGTTAC | 5390 | TGCAGGACCAGAGAATTCGAATA CATATGTAGTNNNCTAGCGTTAC | 5630 |
| TGCAGGACCAGAGAATTCGAATA CACACGTGGCNNNCTAGCGTTAC | 5151 | TGCAGGACCAGAGAATTCGAATA CACATGGCCNNNCTAGCGTTAC | 5391 | TGCAGGACCAGAGAATTCGAATA CAATCTCTCGNNNCTAGCGTTAC | 5631 |
| TGCAGGACCAGAGAATTCGAATA CACCAGTCGNNNCTAGCGTTAC | 5152 | TGCAGGACCAGAGAATTCGAATA CAGGAAGATCNNNCTAGCGTTAC | 5392 | TGCAGGACCAGAGAATTCGAATA CAGTGTTTCCNNNCTAGCGTTAC | 5632 |
| TGCAGGACCAGAGAATTCGAATA CACACCCCTGNNNCTAGCGTTAC | 5153 | TGCAGGACCAGAGAATTCGAATA CATCAGCTAGNNNCTAGCGTTAC | 5393 | TGCAGGACCAGAGAATTCGAATA CACGTAGTACNNNCTAGCGTTAC | 5633 |
| TGCAGGACCAGAGAATTCGAATA CACAATACATNNNCTAGCGTTAC | 5154 | TGCAGGACCAGAGAATTCGAATA CACTGCTAAGNNNCTAGCGTTAC | 5394 | TGCAGGACCAGAGAATTCGAATA CAGCCGAAATNNNCTAGCGTTAC | 5634 |
| TGCAGGACCAGAGAATTCGAATA CACTGCATAGNNNCTAGCGTTAC | 5155 | TGCAGGACCAGAGAATTCGAATA CACACTTGGANNNCTAGCGTTAC | 5395 | TGCAGGACCAGAGAATTCGAATA CATAATTCAGNNNCTAGCGTTAC | 5635 |
| TGCAGGACCAGAGAATTCGAATA CACTGAAAAANNNCTAGCGTTAC | 5156 | TGCAGGACCAGAGAATTCGAATA CACTCGAATGNNNCTAGCGTTAC | 5396 | TGCAGGACCAGAGAATTCGAATA CACGCGCGGCNNNCTAGCGTTAC | 5636 |
| TGCAGGACCAGAGAATTCGAATA CAGTCCATTCNNNCTAGCGTTAC | 5157 | TGCAGGACCAGAGAATTCGAATA CACGCTTAAGNNNCTAGCGTTAC | 5397 | TGCAGGACCAGAGAATTCGAATA CACGAAGAGTNNNCTAGCGTTAC | 5637 |
| TGCAGGACCAGAGAATTCGAATA CATTAGTGGCNNNCTAGCGTTAC | 5158 | TGCAGGACCAGAGAATTCGAATA CAATATTGTGNNNCTAGCGTTAC | 5398 | TGCAGGACCAGAGAATTCGAATA CAAGCGTGTTNNNCTAGCGTTAC | 5638 |
| TGCAGGACCAGAGAATTCGAATA CAACTGGCATNNNCTAGCGTTAC | 5159 | TGCAGGACCAGAGAATTCGAATA CATTTCACGCNNNCTAGCGTTAC | 5399 | TGCAGGACCAGAGAATTCGAATA CACGAAAGCANNNCTAGCGTTAC | 5639 |
| TGCAGGACCAGAGAATTCGAATA CAATGGTTGCNNNCTAGCGTTAC | 5160 | TGCAGGACCAGAGAATTCGAATA CATTCCATCGNNNCTAGCGTTAC | 5400 | TGCAGGACCAGAGAATTCGAATA CAGTCTACCTNNNCTAGCGTTAC | 5640 |
| TGCAGGACCAGAGAATTCGAATA CATGGCTCCCNNNCTAGCGTTAC | 5161 | TGCAGGACCAGAGAATTCGAATA CAAATGCACNNNCTAGCGTTAC | 5401 | TGCAGGACCAGAGAATTCGAATA CACATGCGGCNNNCTAGCGTTAC | 5641 |
| TGCAGGACCAGAGAATTCGAATA CAGATTTTTCNNNCTAGCGTTAC | 5162 | TGCAGGACCAGAGAATTCGAATA CAATCAGTCGNNNCTAGCGTTAC | 5402 | TGCAGGACCAGAGAATTCGAATA CATGACCGGCNNNCTAGCGTTAC | 5642 |
| TGCAGGACCAGAGAATTCGAATA CAGCCTACAANNNCTAGCGTTAC | 5163 | TGCAGGACCAGAGAATTCGAATA CACTCTGAAGNNNCTAGCGTTAC | 5403 | TGCAGGACCAGAGAATTCGAATA CAACTTTAGANNNCTAGCGTTAC | 5643 |
| TGCAGGACCAGAGAATTCGAATA CAGGATTCACNNNCTAGCGTTAC | 5164 | TGCAGGACCAGAGAATTCGAATA CAAAAGTGATNNNCTAGCGTTAC | 5404 | TGCAGGACCAGAGAATTCGAATA CAAGCTCGCGNNNCTAGCGTTAC | 5644 |
| TGCAGGACCAGAGAATTCGAATA CAATTCGCAGNNNCTAGCGTTAC | 5165 | TGCAGGACCAGAGAATTCGAATA CATCAACCTCNNNCTAGCGTTAC | 5405 | TGCAGGACCAGAGAATTCGAATA CAAGACATCCNNNCTAGCGTTAC | 5645 |
| TGCAGGACCAGAGAATTCGAATA CACGGCTACGNNNCTAGCGTTAC | 5166 | TGCAGGACCAGAGAATTCGAATA CAGCTAATGCNNNCTAGCGTTAC | 5406 | TGCAGGACCAGAGAATTCGAATA CACTCAATGGNNNCTAGCGTTAC | 5646 |
| TGCAGGACCAGAGAATTCGAATA CAATCCTAGGNNNCTAGCGTTAC | 5167 | TGCAGGACCAGAGAATTCGAATA CATATTGGCNNNCTAGCGTTAC | 5407 | TGCAGGACCAGAGAATTCGAATA CATATTCCGCNNNCTAGCGTTAC | 5647 |
| TGCAGGACCAGAGAATTCGAATA CATCGTACCTNNNCTAGCGTTAC | 5168 | TGCAGGACCAGAGAATTCGAATA CATACTATCTNNNCTAGCGTTAC | 5408 | TGCAGGACCAGAGAATTCGAATA CATTCACCTGNNNCTAGCGTTAC | 5648 |
| TGCAGGACCAGAGAATTCGAATA CACATCTAAANNNGATCGACATG | 5169 | TGCAGGACCAGAGAATTCGAATA CAGACTCGGNNNGATCGACATG | 5409 | TGCAGGACCAGAGAATTCGAATA CACTCTGTACNNNGATCGACATG | 5649 |
| TGCAGGACCAGAGAATTCGAATA CAAGTGAACGNNNGATCGACATG | 5170 | TGCAGGACCAGAGAATTCGAATA CAGCTGTATGNNNGATCGACATG | 5410 | TGCAGGACCAGAGAATTCGAATA CATTGATTCNNNGATCGACATG | 5650 |
| TGCAGGACCAGAGAATTCGAATA CACTGAACTGNNNGATCGACATG | 5171 | TGCAGGACCAGAGAATTCGAATA CAAAAATTGCTNNNGATCGACATG | 5411 | TGCAGGACCAGAGAATTCGAATA CAGCACATACNNNGATCGACATG | 5651 |
| TGCAGGACCAGAGAATTCGAATA CAGATACGAGNNNGATCGACATG | 5172 | TGCAGGACCAGAGAATTCGAATA CAACATGTTANNNGATCGACATG | 5412 | TGCAGGACCAGAGAATTCGAATA CAGCTTGTGANNNGATCGACATG | 5652 |
| TGCAGGACCAGAGAATTCGAATA CATTTCCTAANNNGATCGACATG | 5173 | TGCAGGACCAGAGAATTCGAATA CAAGATGGACNNNGATCGACATG | 5413 | TGCAGGACCAGAGAATTCGAATA CATACGGTACNNNGATCGACATG | 5653 |
| TGCAGGACCAGAGAATTCGAATA CATAGTCTTNNNGATCGACATG | 5174 | TGCAGGACCAGAGAATTCGAATA CATGTCTCCANNNGATCGACATG | 5414 | TGCAGGACCAGAGAATTCGAATA CACACGGTCGNNNGATCGACATG | 5654 |
| TGCAGGACCAGAGAATTCGAATA CAAGTTGCCANNNGATCGACATG | 5175 | TGCAGGACCAGAGAATTCGAATA CATTGGCTAGNNNGATCGACATG | 5415 | TGCAGGACCAGAGAATTCGAATA CACCAAGGTTNNNGATCGACATG | 5655 |
| TGCAGGACCAGAGAATTCGAATA CAAGCGACAANNNGATCGACATG | 5176 | TGCAGGACCAGAGAATTCGAATA CATAATTTCCNNNGATCGACATG | 5416 | TGCAGGACCAGAGAATTCGAATA CAGTTCGGCGNNNGATCGACATG | 5656 |
| TGCAGGACCAGAGAATTCGAATA CAGGATAAATNNNGATCGACATG | 5177 | TGCAGGACCAGAGAATTCGAATA CAGTGTTAATNNNGATCGACATG | 5417 | TGCAGGACCAGAGAATTCGAATA CAACGCAGCCNNNGATCGACATG | 5657 |
| TGCAGGACCAGAGAATTCGAATA CATTTGAAACNNNGATCGACATG | 5178 | TGCAGGACCAGAGAATTCGAATA CATGAGCAAGNNNGATCGACATG | 5418 | TGCAGGACCAGAGAATTCGAATA CACCCCGAGANNNGATCGACATG | 5658 |
| TGCAGGACCAGAGAATTCGAATA CAGAGATACNNNGATCGACATG | 5179 | TGCAGGACCAGAGAATTCGAATA CACGGCCCTANNNGATCGACATG | 5419 | TGCAGGACCAGAGAATTCGAATA CACTCCATGTNNNGATCGACATG | 5659 |
| TGCAGGACCAGAGAATTCGAATA CAACTGGATCNNNGATCGACATG | 5180 | TGCAGGACCAGAGAATTCGAATA CAGTCACAGTNNNGATCGACATG | 5420 | TGCAGGACCAGAGAATTCGAATA CATTTGCACCNNNGATCGACATG | 5660 |

FIG. 19E

| Pool-22 | SEQ ID NO: | Pool-23 | SEQ ID NO: | Pool-24 | SEQ ID NO: |
|---|---|---|---|---|---|
| TGCAGGACCAGAGAATTCGAATA CAAAATGGATNNNGATCGACATG | 5181 | TGCAGGACCAGAGAATTCGAATA CAGTTGGTGTNNNGATCGACATG | 5421 | TGCAGGACCAGAGAATTCGAATA CAATTACAACNNNGATCGACATG | 5661 |
| TGCAGGACCAGAGAATTCGAATA CACGCATGATNNNGATCGACATG | 5182 | TGCAGGACCAGAGAATTCGAATA CACTTATTACNNNGATCGACATG | 5422 | TGCAGGACCAGAGAATTCGAATA CATGCCCACCNNNGATCGACATG | 5662 |
| TGCAGGACCAGAGAATTCGAATA CATACGAATTNNNGATCGACATG | 5183 | TGCAGGACCAGAGAATTCGAATA CACTCGCAAANNNGATCGACATG | 5423 | TGCAGGACCAGAGAATTCGAATA CAGATTGGAGNNNGATCGACATG | 5663 |
| TGCAGGACCAGAGAATTCGAATA CAGGAAAGCTNNNGATCGACATG | 5184 | TGCAGGACCAGAGAATTCGAATA CACTAGGTGTNNNGATCGACATG | 5424 | TGCAGGACCAGAGAATTCGAATA CATCGTACCCNNNGATCGACATG | 5664 |
| TGCAGGACCAGAGAATTCGAATA CACCAACAACNNNGATCGACATG | 5185 | TGCAGGACCAGAGAATTCGAATA CACAACATATNNNGATCGACATG | 5425 | TGCAGGACCAGAGAATTCGAATA CAGGTGGATANNNGATCGACATG | 5665 |
| TGCAGGACCAGAGAATTCGAATA CAACGCGACCNNNGATCGACATG | 5186 | TGCAGGACCAGAGAATTCGAATA CAACCGATACNNNGATCGACATG | 5426 | TGCAGGACCAGAGAATTCGAATA CAGACATTCGNNNGATCGACATG | 5666 |
| TGCAGGACCAGAGAATTCGAATA CAGGAGTCCCNNNGATCGACATG | 5187 | TGCAGGACCAGAGAATTCGAATA CACGGACTGGNNNGATCGACATG | 5427 | TGCAGGACCAGAGAATTCGAATA CAATCTGCGANNNGATCGACATG | 5667 |
| TGCAGGACCAGAGAATTCGAATA CACCACGCAGNNNGATCGACATG | 5188 | TGCAGGACCAGAGAATTCGAATA CACAACGCATNNNGATCGACATG | 5428 | TGCAGGACCAGAGAATTCGAATA CAGGCACCANNNGATCGACATG | 5668 |
| TGCAGGACCAGAGAATTCGAATA CAACTCGCCCNNNGATCGACATG | 5189 | TGCAGGACCAGAGAATTCGAATA CATTTTAATTNNNGATCGACATG | 5429 | TGCAGGACCAGAGAATTCGAATA CAAATGTTTGNNNGATCGACATG | 5669 |
| TGCAGGACCAGAGAATTCGAATA CACTGAAGAGNNNGATCGACATG | 5190 | TGCAGGACCAGAGAATTCGAATA CAAGTGTATTNNNGATCGACATG | 5430 | TGCAGGACCAGAGAATTCGAATA CAACCTGGTANNNGATCGACATG | 5670 |
| TGCAGGACCAGAGAATTCGAATA CAGGAGCACGNNNGATCGACATG | 5191 | TGCAGGACCAGAGAATTCGAATA CAACTTCAGGNNNGATCGACATG | 5431 | TGCAGGACCAGAGAATTCGAATA CAACTGAGAGNNNGATCGACATG | 5671 |
| TGCAGGACCAGAGAATTCGAATA CAGGAGGACCNNNGATCGACATG | 5192 | TGCAGGACCAGAGAATTCGAATA CAAAGCCGCCNNNGATCGACATG | 5432 | TGCAGGACCAGAGAATTCGAATA CAGAATTAAGNNNGATCGACATG | 5672 |
| TGCAGGACCAGAGAATTCGAATA CAGGAACCTTNNNGATCGACATG | 5193 | TGCAGGACCAGAGAATTCGAATA CACCACGGTGNNNGATCGACATG | 5433 | TGCAGGACCAGAGAATTCGAATA CAATTACGGCNNNGATCGACATG | 5673 |
| TGCAGGACCAGAGAATTCGAATA CAGCCCTGTCNNNGATCGACATG | 5194 | TGCAGGACCAGAGAATTCGAATA CAGGCTCTTTNNNGATCGACATG | 5434 | TGCAGGACCAGAGAATTCGAATA CACAGTCTAGNNNGATCGACATG | 5674 |
| TGCAGGACCAGAGAATTCGAATA CAAGTAATCTNNNGATCGACATG | 5195 | TGCAGGACCAGAGAATTCGAATA CACTTAGCCTNNNGATCGACATG | 5435 | TGCAGGACCAGAGAATTCGAATA CAATCCCTTGNNNGATCGACATG | 5675 |
| TGCAGGACCAGAGAATTCGAATA CACGCTCGAGNNNGATCGACATG | 5196 | TGCAGGACCAGAGAATTCGAATA CAATTAGCATNNNGATCGACATG | 5436 | TGCAGGACCAGAGAATTCGAATA CATGTCCACTNNNGATCGACATG | 5676 |
| TGCAGGACCAGAGAATTCGAATA CAGTCATGGTNNNGATCGACATG | 5197 | TGCAGGACCAGAGAATTCGAATA CAGCAGCTTANNNGATCGACATG | 5437 | TGCAGGACCAGAGAATTCGAATA CAGGTACGCCNNNGATCGACATG | 5677 |
| TGCAGGACCAGAGAATTCGAATA CAGATTCCAGNNNGATCGACATG | 5198 | TGCAGGACCAGAGAATTCGAATA CAACATACGCNNNGATCGACATG | 5438 | TGCAGGACCAGAGAATTCGAATA CATGAGCAGANNNGATCGACATG | 5678 |
| TGCAGGACCAGAGAATTCGAATA CACTATTACTNNNGATCGACATG | 5199 | TGCAGGACCAGAGAATTCGAATA CAGTCGAAAGNNNGATCGACATG | 5439 | TGCAGGACCAGAGAATTCGAATA CAGATCCGTANNNGATCGACATG | 5679 |
| TGCAGGACCAGAGAATTCGAATA CAAGGTCTACNNNGATCGACATG | 5200 | TGCAGGACCAGAGAATTCGAATA CATTCTAGTTNNNGATCGACATG | 5440 | TGCAGGACCAGAGAATTCGAATA CATCACTAAANNNGATCGACATG | 5680 |
| TGCAGGACCAGAGAATTCGAATA CACCTGTAGANNNGATCGACATG | 5201 | TGCAGGACCAGAGAATTCGAATA CACACGCTCGNNNGATCGACATG | 5441 | TGCAGGACCAGAGAATTCGAATA CAAATAGATANNNGATCGACATG | 5681 |
| TGCAGGACCAGAGAATTCGAATA CATCCTGTCANNNGATCGACATG | 5202 | TGCAGGACCAGAGAATTCGAATA CACCGAGGTCNNNGATCGACATG | 5442 | TGCAGGACCAGAGAATTCGAATA CATCGCGCTCNNNGATCGACATG | 5682 |
| TGCAGGACCAGAGAATTCGAATA CACCCTGCGTNNNGATCGACATG | 5203 | TGCAGGACCAGAGAATTCGAATA CACATTCAGGNNNGATCGACATG | 5443 | TGCAGGACCAGAGAATTCGAATA CAACCGACCANNNGATCGACATG | 5683 |
| TGCAGGACCAGAGAATTCGAATA CAACAATGANNNGATCGACATG | 5204 | TGCAGGACCAGAGAATTCGAATA CATCCATAGGNNNGATCGACATG | 5444 | TGCAGGACCAGAGAATTCGAATA CACACGGACCNNNGATCGACATG | 5684 |
| TGCAGGACCAGAGAATTCGAATA CAGGTGGAGCNNNGATCGACATG | 5205 | TGCAGGACCAGAGAATTCGAATA CATTACTCATNNNGATCGACATG | 5445 | TGCAGGACCAGAGAATTCGAATA CAATATCCGATNNNGATCGACATG | 5685 |
| TGCAGGACCAGAGAATTCGAATA CAGGATAGACNNNGATCGACATG | 5206 | TGCAGGACCAGAGAATTCGAATA CAATCTGATANNNGATCGACATG | 5446 | TGCAGGACCAGAGAATTCGAATA CATACCACGANNNGATCGACATG | 5686 |
| TGCAGGACCAGAGAATTCGAATA CAGAGTGCCCNNNGATCGACATG | 5207 | TGCAGGACCAGAGAATTCGAATA CAGTCCACTTNNNGATCGACATG | 5447 | TGCAGGACCAGAGAATTCGAATA CAAAGAACGCNNNGATCGACATG | 5687 |
| TGCAGGACCAGAGAATTCGAATA CAAAACGGTGNNNGATCGACATG | 5208 | TGCAGGACCAGAGAATTCGAATA CACAGGAACANNNGATCGACATG | 5448 | TGCAGGACCAGAGAATTCGAATA CAAGTACCTGNNNGATCGACATG | 5688 |
| TGCAGGACCAGAGAATTCGAATA CAAATAGCAANNNGATCGACATG | 5209 | TGCAGGACCAGAGAATTCGAATA CACTAGCTTCNNNGATCGACATG | 5449 | TGCAGGACCAGAGAATTCGAATA CAGTTTTAGANNNGATCGACATG | 5689 |
| TGCAGGACCAGAGAATTCGAATA CATCAATTGANNNGATCGACATG | 5210 | TGCAGGACCAGAGAATTCGAATA CATTTGGCGANNNGATCGACATG | 5450 | TGCAGGACCAGAGAATTCGAATA CAGGATTTTANNNGATCGACATG | 5690 |
| TGCAGGACCAGAGAATTCGAATA CAAGCAATGGNNNGATCGACATG | 5211 | TGCAGGACCAGAGAATTCGAATA CACCCGAAGCNNNGATCGACATG | 5451 | TGCAGGACCAGAGAATTCGAATA CATAGTATACNNNGATCGACATG | 5691 |
| TGCAGGACCAGAGAATTCGAATA CAGTAGTGAGNNNGATCGACATG | 5212 | TGCAGGACCAGAGAATTCGAATA CATCCCAACTNNNGATCGACATG | 5452 | TGCAGGACCAGAGAATTCGAATA CACGTATGGTNNNGATCGACATG | 5692 |
| TGCAGGACCAGAGAATTCGAATA CACACTGCGNNNGATCGACATG | 5213 | TGCAGGACCAGAGAATTCGAATA CATTCACGGANNNGATCGACATG | 5453 | TGCAGGACCAGAGAATTCGAATA CATCCCGGCTNNNGATCGACATG | 5693 |

FIG. 19F

| Pool-22 | SEQ ID NO: | Pool-23 | SEQ ID NO: | Pool-24 | SEQ ID NO: |
|---|---|---|---|---|---|
| TGCAGGACCAGAGAATTCGAATA CAACCCCTCCNNNGATCGACATG | 5214 | TGCAGGACCAGAGAATTCGAATA CAATTTTACCNNNGATCGACATG | 5454 | TGCAGGACCAGAGAATTCGAATA CAGCGCTCTCNNNGATCGACATG | 5694 |
| TGCAGGACCAGAGAATTCGAATA CACTAGGTTGNNNGATCGACATG | 5215 | TGCAGGACCAGAGAATTCGAATA CATGGAGTCTNNNGATCGACATG | 5455 | TGCAGGACCAGAGAATTCGAATA CACATTCCCANNNGATCGACATG | 5695 |
| TGCAGGACCAGAGAATTCGAATA CATAAAATAANNNGATCGACATG | 5216 | TGCAGGACCAGAGAATTCGAATA CACGACGACNNNGATCGACATG | 5456 | TGCAGGACCAGAGAATTCGAATA CATCGCCCCANNNGATCGACATG | 5696 |
| TGCAGGACCAGAGAATTCGAATA CAGTCACGTANNNGATCGACATG | 5217 | TGCAGGACCAGAGAATTCGAATA CATCCCATACNNNGATCGACATG | 5457 | TGCAGGACCAGAGAATTCGAATA CATGCATTGGNNNGATCGACATG | 5697 |
| TGCAGGACCAGAGAATTCGAATA CAGGTTCGATNNNGATCGACATG | 5218 | TGCAGGACCAGAGAATTCGAATA CAGCCCTTATNNNGATCGACATG | 5458 | TGCAGGACCAGAGAATTCGAATA CAATCAGATTNNNGATCGACATG | 5698 |
| TGCAGGACCAGAGAATTCGAATA CACAATGGAGNNNGATCGACATG | 5219 | TGCAGGACCAGAGAATTCGAATA CAGTCCCGCTNNNGATCGACATG | 5459 | TGCAGGACCAGAGAATTCGAATA CACTTTTATGNNNGATCGACATG | 5699 |
| TGCAGGACCAGAGAATTCGAATA CACCGAGCGTNNNGATCGACATG | 5220 | TGCAGGACCAGAGAATTCGAATA CACGGCCCTTNNNGATCGACATG | 5460 | TGCAGGACCAGAGAATTCGAATA CAAAAGTCGGNNNGATCGACATG | 5700 |
| TGCAGGACCAGAGAATTCGAATA CACAAACGAGNNNGATCGACATG | 5221 | TGCAGGACCAGAGAATTCGAATA CATCAGCTTCNNNGATCGACATG | 5461 | TGCAGGACCAGAGAATTCGAATA CAACGAGTGANNNGATCGACATG | 5701 |
| TGCAGGACCAGAGAATTCGAATA CAGATATGTTNNNGATCGACATG | 5222 | TGCAGGACCAGAGAATTCGAATA CAGGCTCGGTNNNGATCGACATG | 5462 | TGCAGGACCAGAGAATTCGAATA CAGAAATTAGNNNGATCGACATG | 5702 |
| TGCAGGACCAGAGAATTCGAATA CAGTTCTGTCNNNGATCGACATG | 5223 | TGCAGGACCAGAGAATTCGAATA CAAAGTTCGCNNNGATCGACATG | 5463 | TGCAGGACCAGAGAATTCGAATA CAATTATCTCNNNGATCGACATG | 5703 |
| TGCAGGACCAGAGAATTCGAATA CATCTTTTCTNNNGATCGACATG | 5224 | TGCAGGACCAGAGAATTCGAATA CAAACGCCGNNNGATCGACATG | 5464 | TGCAGGACCAGAGAATTCGAATA CAGCTCGGCANNNGATCGACATG | 5704 |
| TGCAGGACCAGAGAATTCGAATA CAAAAGACATNNNGATCGACATG | 5225 | TGCAGGACCAGAGAATTCGAATA CATTCTACTATCNNNGATCGACATG | 5465 | TGCAGGACCAGAGAATTCGAATA CAGTTAGAGGNNNGATCGACATG | 5705 |
| TGCAGGACCAGAGAATTCGAATA CAACCCATGANNNGATCGACATG | 5226 | TGCAGGACCAGAGAATTCGAATA CATTCAAGATNNNGATCGACATG | 5466 | TGCAGGACCAGAGAATTCGAATA CAACCAGCTANNNGATCGACATG | 5706 |
| TGCAGGACCAGAGAATTCGAATA CATCCTCACANNNGATCGACATG | 5227 | TGCAGGACCAGAGAATTCGAATA CACTCAGTTCNNNGATCGACATG | 5467 | TGCAGGACCAGAGAATTCGAATA CAGGAGTGCGNNNGATCGACATG | 5707 |
| TGCAGGACCAGAGAATTCGAATA CATTGAGGTCNNNGATCGACATG | 5228 | TGCAGGACCAGAGAATTCGAATA CAAAGAATTGNNNGATCGACATG | 5468 | TGCAGGACCAGAGAATTCGAATA CATCGATATANNNGATCGACATG | 5708 |
| TGCAGGACCAGAGAATTCGAATA CAGCGTACTANNNTGCATCAGGT | 5229 | TGCAGGACCAGAGAATTCGAATA CAGACTACCANNNTGCATCAGGT | 5469 | TGCAGGACCAGAGAATTCGAATA CAGCGCTAGCNNNTGCATCAGGT | 5709 |
| TGCAGGACCAGAGAATTCGAATA CAAGGTTAGGNNNTGCATCAGGT | 5230 | TGCAGGACCAGAGAATTCGAATA CACACGCTAANNNTGCATCAGGT | 5470 | TGCAGGACCAGAGAATTCGAATA CACTGATTAANNNTGCATCAGGT | 5710 |
| TGCAGGACCAGAGAATTCGAATA CACTCCACATNNNTGCATCAGGT | 5231 | TGCAGGACCAGAGAATTCGAATA CAAGTCATATNNNTGCATCAGGT | 5471 | TGCAGGACCAGAGAATTCGAATA CACACTTCACNNNTGCATCAGGT | 5711 |
| TGCAGGACCAGAGAATTCGAATA CACGATCTAGNNNTGCATCAGGT | 5232 | TGCAGGACCAGAGAATTCGAATA CATCTAGGACNNNTGCATCAGGT | 5472 | TGCAGGACCAGAGAATTCGAATA CATAGGCGTTNNNTGCATCAGGT | 5712 |
| TGCAGGACCAGAGAATTCGAATA CATCGATAATNNNTGCATCAGGT | 5233 | TGCAGGACCAGAGAATTCGAATA CAAGAACTTTNNNTGCATCAGGT | 5473 | TGCAGGACCAGAGAATTCGAATA CAATATGTCANNNTGCATCAGGT | 5713 |
| TGCAGGACCAGAGAATTCGAATA CACCACGAGCNNNTGCATCAGGT | 5234 | TGCAGGACCAGAGAATTCGAATA CAACCACTGANNNTGCATCAGGT | 5474 | TGCAGGACCAGAGAATTCGAATA CAGTCGATTGNNNTGCATCAGGT | 5714 |
| TGCAGGACCAGAGAATTCGAATA CAGTGGAATGNNNTGCATCAGGT | 5235 | TGCAGGACCAGAGAATTCGAATA CAACACGATCNNNTGCATCAGGT | 5475 | TGCAGGACCAGAGAATTCGAATA CAATAGAGCGNNNTGCATCAGGT | 5715 |
| TGCAGGACCAGAGAATTCGAATA CAAAAAATGCNNNTGCATCAGGT | 5236 | TGCAGGACCAGAGAATTCGAATA CAGTTACCAGNNNTGCATCAGGT | 5476 | TGCAGGACCAGAGAATTCGAATA CAGACTAAGGNNNTGCATCAGGT | 5716 |
| TGCAGGACCAGAGAATTCGAATA CAGACTAGTCNNNTGCATCAGGT | 5237 | TGCAGGACCAGAGAATTCGAATA CACGCTACCCNNNTGCATCAGGT | 5477 | TGCAGGACCAGAGAATTCGAATA CACCTACCTANNNTGCATCAGGT | 5717 |
| TGCAGGACCAGAGAATTCGAATA CACGTAGAAGNNNTGCATCAGGT | 5238 | TGCAGGACCAGAGAATTCGAATA CAAGAGGTACNNNTGCATCAGGT | 5478 | TGCAGGACCAGAGAATTCGAATA CATAGGAGACNNNTGCATCAGGT | 5718 |
| TGCAGGACCAGAGAATTCGAATA CAGTGTGAAGNNNTGCATCAGGT | 5239 | TGCAGGACCAGAGAATTCGAATA CAAATCTCTTNNNTGCATCAGGT | 5479 | TGCAGGACCAGAGAATTCGAATA CACCGTCATTNNNTGCATCAGGT | 5719 |
| TGCAGGACCAGAGAATTCGAATA CAAAGTACTTNNNTGCATCAGGT | 5240 | TGCAGGACCAGAGAATTCGAATA CAATATTTAANNNTGCATCAGGT | 5480 | TGCAGGACCAGAGAATTCGAATA CAGTGTTCAGNNNTGCATCAGGT | 5720 |
| TGCAGGACCAGAGAATTCGAATA CACGAACGTTNNNTGCATCAGGT | 5241 | TGCAGGACCAGAGAATTCGAATA CATATCGAATNNNTGCATCAGGT | 5481 | TGCAGGACCAGAGAATTCGAATA CAAGCGGTTTNNNTGCATCAGGT | 5721 |
| TGCAGGACCAGAGAATTCGAATA CAATTGCTGGNNNTGCATCAGGT | 5242 | TGCAGGACCAGAGAATTCGAATA CAGCTAAATTNNNTGCATCAGGT | 5482 | TGCAGGACCAGAGAATTCGAATA CAAACTCTTTNNNTGCATCAGGT | 5722 |
| TGCAGGACCAGAGAATTCGAATA CATGTGTGTGNNNTGCATCAGGT | 5243 | TGCAGGACCAGAGAATTCGAATA CATTTGACCGNNNTGCATCAGGT | 5483 | TGCAGGACCAGAGAATTCGAATA CATAACGTATNNNTGCATCAGGT | 5723 |
| TGCAGGACCAGAGAATTCGAATA CAACATCTTTNNNTGCATCAGGT | 5244 | TGCAGGACCAGAGAATTCGAATA CAGTTCACAGNNNTGCATCAGGT | 5484 | TGCAGGACCAGAGAATTCGAATA CAAAGGACTGNNNTGCATCAGGT | 5724 |
| TGCAGGACCAGAGAATTCGAATA CACGATGCTANNNTGCATCAGGT | 5245 | TGCAGGACCAGAGAATTCGAATA CAGCGATTCCTNNNTGCATCAGGT | 5485 | TGCAGGACCAGAGAATTCGAATA CAAGGAGACNNNTGCATCAGGT | 5725 |
| TGCAGGACCAGAGAATTCGAATA CATAGTCCAGNNNTGCATCAGGT | 5246 | TGCAGGACCAGAGAATTCGAATA CATTACACCCNNNTGCATCAGGT | 5486 | TGCAGGACCAGAGAATTCGAATA CATCGAACGTNNNTGCATCAGGT | 5726 |

FIG. 19G

| Pool-22 | SEQ ID NO: | Pool-23 | SEQ ID NO: | Pool-24 | SEQ ID NO: |
|---|---|---|---|---|---|
| TGCAGGACCAGAGAATTCGAATACACAGTAATTNNNTGCATCAGGT | 5247 | TGCAGGACCAGAGAATTCGAATACATATTTTATNNNTGCATCAGGT | 5487 | TGCAGGACCAGAGAATTCGAATACACGGACATTNNNTGCATCAGGT | 5727 |
| TGCAGGACCAGAGAATTCGAATACAAAGGTGGTNNNTGCATCAGGT | 5248 | TGCAGGACCAGAGAATTCGAATACATGTCCGCCNNNTGCATCAGGT | 5488 | TGCAGGACCAGAGAATTCGAATACATTCCGCATNNNTGCATCAGGT | 5728 |
| TGCAGGACCAGAGAATTCGAATACACGGTGGTCNNNTGCATCAGGT | 5249 | TGCAGGACCAGAGAATTCGAATACAAAACCCGTNNNTGCATCAGGT | 5489 | TGCAGGACCAGAGAATTCGAATACACGCGGCTANNNTGCATCAGGT | 5729 |
| TGCAGGACCAGAGAATTCGAATACAGTGGTTGTNNNTGCATCAGGT | 5250 | TGCAGGACCAGAGAATTCGAATACAGTACCGATNNNTGCATCAGGT | 5490 | TGCAGGACCAGAGAATTCGAATACAGTTTCTGCNNNTGCATCAGGT | 5730 |
| TGCAGGACCAGAGAATTCGAATACATGTATTCTNNNTGCATCAGGT | 5251 | TGCAGGACCAGAGAATTCGAATACACGCGTTCNNNTGCATCAGGT | 5491 | TGCAGGACCAGAGAATTCGAATACAAGACAGCANNNTGCATCAGGT | 5731 |
| TGCAGGACCAGAGAATTCGAATACATAAGTCGCNNNTGCATCAGGT | 5252 | TGCAGGACCAGAGAATTCGAATACACTCCAATCNNNTGCATCAGGT | 5492 | TGCAGGACCAGAGAATTCGAATACAGACCCTCCNNNTGCATCAGGT | 5732 |
| TGCAGGACCAGAGAATTCGAATACATAGGAGCANNNTGCATCAGGT | 5253 | TGCAGGACCAGAGAATTCGAATACACCGCAGACNNNTGCATCAGGT | 5493 | TGCAGGACCAGAGAATTCGAATACATACTCGCTNNNTGCATCAGGT | 5733 |
| TGCAGGACCAGAGAATTCGAATACACATAAATCNNNTGCATCAGGT | 5254 | TGCAGGACCAGAGAATTCGAATACACGCTTAGANNNTGCATCAGGT | 5494 | TGCAGGACCAGAGAATTCGAATACATTCGTATTNNNTGCATCAGGT | 5734 |
| TGCAGGACCAGAGAATTCGAATACAAGCTGTACNNNTGCATCAGGT | 5255 | TGCAGGACCAGAGAATTCGAATACAGAAAAGCNNNTGCATCAGGT | 5495 | TGCAGGACCAGAGAATTCGAATACATACTTAAGNNNTGCATCAGGT | 5735 |
| TGCAGGACCAGAGAATTCGAATACATTGCGCTNNNTGCATCAGGT | 5256 | TGCAGGACCAGAGAATTCGAATACACTCATCCANNNTGCATCAGGT | 5496 | TGCAGGACCAGAGAATTCGAATACAGACTACGTNNNTGCATCAGGT | 5736 |
| TGCAGGACCAGAGAATTCGAATACAAGCGTGNNNTGCATCAGGT | 5257 | TGCAGGACCAGAGAATTCGAATACAAAGAGTATNNNTGCATCAGGT | 5497 | TGCAGGACCAGAGAATTCGAATACAACGAGTCTNNNTGCATCAGGT | 5737 |
| TGCAGGACCAGAGAATTCGAATACAGTCTAGGTNNNTGCATCAGGT | 5258 | TGCAGGACCAGAGAATTCGAATACAAATTGTCANNNTGCATCAGGT | 5498 | TGCAGGACCAGAGAATTCGAATACAGACCGTTGNNNTGCATCAGGT | 5738 |
| TGCAGGACCAGAGAATTCGAATACATCCGTAAGNNNTGCATCAGGT | 5259 | TGCAGGACCAGAGAATTCGAATACAATAATACCNNNTGCATCAGGT | 5499 | TGCAGGACCAGAGAATTCGAATACAGATGGACANNNTGCATCAGGT | 5739 |
| TGCAGGACCAGAGAATTCGAATACATATCGGCANNNTGCATCAGGT | 5260 | TGCAGGACCAGAGAATTCGAATACAAATTTTGCNNNTGCATCAGGT | 5500 | TGCAGGACCAGAGAATTCGAATACATCGTAGTGNNNTGCATCAGGT | 5740 |
| TGCAGGACCAGAGAATTCGAATACAATCATCGGNNNTGCATCAGGT | 5261 | TGCAGGACCAGAGAATTCGAATACAGCACAGTTNNNTGCATCAGGT | 5501 | TGCAGGACCAGAGAATTCGAATACACCACATCTNNNTGCATCAGGT | 5741 |
| TGCAGGACCAGAGAATTCGAATACAACGTCTGANNNTGCATCAGGT | 5262 | TGCAGGACCAGAGAATTCGAATACATTAAACCANNNTGCATCAGGT | 5502 | TGCAGGACCAGAGAATTCGAATACAGTGCTACANNNTGCATCAGGT | 5742 |
| TGCAGGACCAGAGAATTCGAATACAACGGTACTNNNTGCATCAGGT | 5263 | TGCAGGACCAGAGAATTCGAATACAATGGAGACNNNTGCATCAGGT | 5503 | TGCAGGACCAGAGAATTCGAATACATTCTTCAANNNTGCATCAGGT | 5743 |
| TGCAGGACCAGAGAATTCGAATACATGCAAGGANNNTGCATCAGGT | 5264 | TGCAGGACCAGAGAATTCGAATACAAAAGACGCNNNTGCATCAGGT | 5504 | TGCAGGACCAGAGAATTCGAATACATTACAGTANNNTGCATCAGGT | 5744 |
| TGCAGGACCAGAGAATTCGAATACAAGACTCACNNNTGCATCAGGT | 5265 | TGCAGGACCAGAGAATTCGAATACAATCCGAACNNNTGCATCAGGT | 5505 | TGCAGGACCAGAGAATTCGAATACAAGACGCGGNNNTGCATCAGGT | 5745 |
| TGCAGGACCAGAGAATTCGAATACACAATCAGCNNNTGCATCAGGT | 5266 | TGCAGGACCAGAGAATTCGAATACAGTTAGGAGNNNTGCATCAGGT | 5506 | TGCAGGACCAGAGAATTCGAATACAGGAGCTCCNNNTGCATCAGGT | 5746 |
| TGCAGGACCAGAGAATTCGAATACATGCTGTANNNTGCATCAGGT | 5267 | TGCAGGACCAGAGAATTCGAATACATGGCCCGCNNNTGCATCAGGT | 5507 | TGCAGGACCAGAGAATTCGAATACAATTAACCANNNTGCATCAGGT | 5747 |
| TGCAGGACCAGAGAATTCGAATACAGTTTACCCNNNTGCATCAGGT | 5268 | TGCAGGACCAGAGAATTCGAATACAATGTGCACNNNTGCATCAGGT | 5508 | TGCAGGACCAGAGAATTCGAATACAATCGAGCTNNNTGCATCAGGT | 5748 |
| TGCAGGACCAGAGAATTCGAATACACGTCAGTANNNTGCATCAGGT | 5269 | TGCAGGACCAGAGAATTCGAATACAGTACAACCNNNTGCATCAGGT | 5509 | TGCAGGACCAGAGAATTCGAATACAGGAAACGTNNNTGCATCAGGT | 5749 |
| TGCAGGACCAGAGAATTCGAATACACGACGGAGNNNTGCATCAGGT | 5270 | TGCAGGACCAGAGAATTCGAATACAGTGGCGAGNNNTGCATCAGGT | 5510 | TGCAGGACCAGAGAATTCGAATACATGAAGAGCNNNTGCATCAGGT | 5750 |
| TGCAGGACCAGAGAATTCGAATACAATATGCGCNNNTGCATCAGGT | 5271 | TGCAGGACCAGAGAATTCGAATACAAGCTCTCNNNTGCATCAGGT | 5511 | TGCAGGACCAGAGAATTCGAATACAATCCGGATNNNTGCATCAGGT | 5751 |
| TGCAGGACCAGAGAATTCGAATACAGCTGGCCANNNTGCATCAGGT | 5272 | TGCAGGACCAGAGAATTCGAATACAACCTCTTGNNNTGCATCAGGT | 5512 | TGCAGGACCAGAGAATTCGAATACAGTTGTCTCNNNTGCATCAGGT | 5752 |
| TGCAGGACCAGAGAATTCGAATACACGCGTCTCNNNTGCATCAGGT | 5273 | TGCAGGACCAGAGAATTCGAATACATCAGCGTANNNTGCATCAGGT | 5513 | TGCAGGACCAGAGAATTCGAATACATGGATAGGNNNTGCATCAGGT | 5753 |
| TGCAGGACCAGAGAATTCGAATACAATAAGTGANNNTGCATCAGGT | 5274 | TGCAGGACCAGAGAATTCGAATACATCAGACGTNNNTGCATCAGGT | 5514 | TGCAGGACCAGAGAATTCGAATACAAAACCAGGNNNTGCATCAGGT | 5754 |
| TGCAGGACCAGAGAATTCGAATACAGACAGTCTNNNTGCATCAGGT | 5275 | TGCAGGACCAGAGAATTCGAATACATATAGATCNNNTGCATCAGGT | 5515 | TGCAGGACCAGAGAATTCGAATACACGGCGACTNNNTGCATCAGGT | 5755 |
| TGCAGGACCAGAGAATTCGAATACAGGAGGTANNNTGCATCAGGT | 5276 | TGCAGGACCAGAGAATTCGAATACACCCGCCTNNNTGCATCAGGT | 5516 | TGCAGGACCAGAGAATTCGAATACATTATCGCANNNTGCATCAGGT | 5756 |
| TGCAGGACCAGAGAATTCGAATACACACGAACTNNNTGCATCAGGT | 5277 | TGCAGGACCAGAGAATTCGAATACAGCAGGATANNNTGCATCAGGT | 5517 | TGCAGGACCAGAGAATTCGAATACAAGCCACATNNNTGCATCAGGT | 5757 |
| TGCAGGACCAGAGAATTCGAATACATACACTGGNNNTGCATCAGGT | 5278 | TGCAGGACCAGAGAATTCGAATACAAGAATGCGNNNTGCATCAGGT | 5518 | TGCAGGACCAGAGAATTCGAATACATGCTCATCNNNTGCATCAGGT | 5758 |
| TGCAGGACCAGAGAATTCGAATACAATTTCGTTNNNTGCATCAGGT | 5279 | TGCAGGACCAGAGAATTCGAATACAACAAGTGGNNNTGCATCAGGT | 5519 | TGCAGGACCAGAGAATTCGAATACAGCTGGAGGNNNTGCATCAGGT | 5759 |

FIG. 19H

| Pool-22 | SEQ ID NO: | Pool-23 | SEQ ID NO: | Pool-24 | SEQ ID NO: |
|---|---|---|---|---|---|
| TGCAGGACCAGAGAATTCGAATACATCTGCGCCNNNTGCATCAGGT | 5280 | TGCAGGACCAGAGAATTCGAATACAGTCCGGCANNNTGCATCAGGT | 5520 | TGCAGGACCAGAGAATTCGAATACAAAAGATGTNNNTGCATCAGGT | 5760 |
| TGCAGGACCAGAGAATTCGAATACACGAGCTATNNNTGCATCAGGT | 5281 | TGCAGGACCAGAGAATTCGAATACAGCCCTGAGNNNTGCATCAGGT | 5521 | TGCAGGACCAGAGAATTCGAATACATCAGAAAANNNTGCATCAGGT | 5761 |
| TGCAGGACCAGAGAATTCGAATACAACGCCATANNNTGCATCAGGT | 5282 | TGCAGGACCAGAGAATTCGAATACAAACTATGTNNNTGCATCAGGT | 5522 | TGCAGGACCAGAGAATTCGAATACAGTCCTGAANNNTGCATCAGGT | 5762 |
| TGCAGGACCAGAGAATTCGAATACATCCTCTGANNNTGCATCAGGT | 5283 | TGCAGGACCAGAGAATTCGAATACATCTGATCCNNNTGCATCAGGT | 5523 | TGCAGGACCAGAGAATTCGAATACAGCTAGGCCNNNTGCATCAGGT | 5763 |
| TGCAGGACCAGAGAATTCGAATACAAATTCTAGNNNTGCATCAGGT | 5284 | TGCAGGACCAGAGAATTCGAATACATAATAGAGNNNTGCATCAGGT | 5524 | TGCAGGACCAGAGAATTCGAATACACTCCTGTANNNTGCATCAGGT | 5764 |
| TGCAGGACCAGAGAATTCGAATACACCTCAGCCNNNTGCATCAGGT | 5285 | TGCAGGACCAGAGAATTCGAATACAGGCCGTTGNNNTGCATCAGGT | 5525 | TGCAGGACCAGAGAATTCGAATACATTGATCAANNNTGCATCAGGT | 5765 |
| TGCAGGACCAGAGAATTCGAATACAACCCGGANNNTGCATCAGGT | 5286 | TGCAGGACCAGAGAATTCGAATACACACAAGGNNNTGCATCAGGT | 5526 | TGCAGGACCAGAGAATTCGAATACACTGTTCGTNNNTGCATCAGGT | 5766 |
| TGCAGGACCAGAGAATTCGAATACAGTGATAGGNNNTGCATCAGGT | 5287 | TGCAGGACCAGAGAATTCGAATACACCCTGAAANNNTGCATCAGGT | 5527 | TGCAGGACCAGAGAATTCGAATACATCTTATCANNNTGCATCAGGT | 5767 |
| TGCAGGACCAGAGAATTCGAATACATTGAATTGNNNTGCATCAGGT | 5288 | TGCAGGACCAGAGAATTCGAATACACTGCTGTTNNNTGCATCAGGT | 5528 | TGCAGGACCAGAGAATTCGAATACATACTGGCANNNTGCATCAGGT | 5768 |

FIG. 20A

| Pool-25 | SEQ ID NO: | Pool-26 | SEQ ID NO: | Pool-27 | SEQ ID NO: |
|---|---|---|---|---|---|
| TGCAGGACCAGAGAATTCGAATACAC GCGACGTNNNACGTATGCCA | 5769 | TGCAGGACCAGAGAATTCGAATACAC TCTGCTANNNACGTATGCCA | 6009 | TGCAGGACCAGAGAATTCGAATACAT GTACGCANNNACGTATGCCA | 6249 |
| TGCAGGACCAGAGAATTCGAATACAC CGATCANNNACGTATGCCA | 5770 | TGCAGGACCAGAGAATTCGAATACAT TACATGANNNACGTATGCCA | 6010 | TGCAGGACCAGAGAATTCGAATACAG ATGTGTCNNNACGTATGCCA | 6250 |
| TGCAGGACCAGAGAATTCGAATACAG GCAATCTNNNACGTATGCCA | 5771 | TGCAGGACCAGAGAATTCGAATACAC GAGGATANNNACGTATGCCA | 6011 | TGCAGGACCAGAGAATTCGAATACAC TAGACTGNNNACGTATGCCA | 6251 |
| TGCAGGACCAGAGAATTCGAATACAC TAGGAGANNNACGTATGCCA | 5772 | TGCAGGACCAGAGAATTCGAATACAC GACATGTNNNACGTATGCCA | 6012 | TGCAGGACCAGAGAATTCGAATACAG ATCGTGTNNNACGTATGCCA | 6252 |
| TGCAGGACCAGAGAATTCGAATACAT TGATAACNNNACGTATGCCA | 5773 | TGCAGGACCAGAGAATTCGAATACAC CTTGAAGNNNACGTATGCCA | 6013 | TGCAGGACCAGAGAATTCGAATACAT TATCTCANNNACGTATGCCA | 6253 |
| TGCAGGACCAGAGAATTCGAATACAG AGTACTCNNNACGTATGCCA | 5774 | TGCAGGACCAGAGAATTCGAATACAC AACGATCNNNACGTATGCCA | 6014 | TGCAGGACCAGAGAATTCGAATACAA ACCCTAGNNNACGTATGCCA | 6254 |
| TGCAGGACCAGAGAATTCGAATACAA TGCCGCGNNNACGTATGCCA | 5775 | TGCAGGACCAGAGAATTCGAATACAG ACTAGAGNNNACGTATGCCA | 6015 | TGCAGGACCAGAGAATTCGAATACAT ATCATAGNNNACGTATGCCA | 6255 |
| TGCAGGACCAGAGAATTCGAATACAA AATAGCANNNACGTATGCCA | 5776 | TGCAGGACCAGAGAATTCGAATACAC TGCAGTANNNACGTATGCCA | 6016 | TGCAGGACCAGAGAATTCGAATACAC GTTCGTTNNNACGTATGCCA | 6256 |
| TGCAGGACCAGAGAATTCGAATACAA TCAGACCNNNACGTATGCCA | 5777 | TGCAGGACCAGAGAATTCGAATACAA TGTGACCNNNACGTATGCCA | 6017 | TGCAGGACCAGAGAATTCGAATACAA TACAAGANNNACGTATGCCA | 6257 |
| TGCAGGACCAGAGAATTCGAATACAG GTGCGTCNNNACGTATGCCA | 5778 | TGCAGGACCAGAGAATTCGAATACAA CCGAATTNNNACGTATGCCA | 6018 | TGCAGGACCAGAGAATTCGAATACAG TCCTCATNNNACGTATGCCA | 6258 |
| TGCAGGACCAGAGAATTCGAATACAT CTTTCCCNNNACGTATGCCA | 5779 | TGCAGGACCAGAGAATTCGAATACAA TTGTTTCNNNACGTATGCCA | 6019 | TGCAGGACCAGAGAATTCGAATACAA GTAGCAGNNNACGTATGCCA | 6259 |
| TGCAGGACCAGAGAATTCGAATACAA AATTCCANNNACGTATGCCA | 5780 | TGCAGGACCAGAGAATTCGAATACAC GCCGTGANNNACGTATGCCA | 6020 | TGCAGGACCAGAGAATTCGAATACAG AAAACATNNNACGTATGCCA | 6260 |
| TGCAGGACCAGAGAATTCGAATACAA ATGTGCCNNNACGTATGCCA | 5781 | TGCAGGACCAGAGAATTCGAATACAC ACTCAAGNNNACGTATGCCA | 6021 | TGCAGGACCAGAGAATTCGAATACAT TCGCCTANNNACGTATGCCA | 6261 |
| TGCAGGACCAGAGAATTCGAATACAC ACATGACNNNACGTATGCCA | 5782 | TGCAGGACCAGAGAATTCGAATACAA GCAATCCNNNACGTATGCCA | 6022 | TGCAGGACCAGAGAATTCGAATACAA GAGTTGGNNNACGTATGCCA | 6262 |
| TGCAGGACCAGAGAATTCGAATACAG ACCTGGCNNNACGTATGCCA | 5783 | TGCAGGACCAGAGAATTCGAATACAT CCATTATNNNACGTATGCCA | 6023 | TGCAGGACCAGAGAATTCGAATACAC AATATTGNNNACGTATGCCA | 6263 |
| TGCAGGACCAGAGAATTCGAATACAC CAAAATTNNNACGTATGCCA | 5784 | TGCAGGACCAGAGAATTCGAATACAA ATTGCTANNNACGTATGCCA | 6024 | TGCAGGACCAGAGAATTCGAATACAA AACCTCGNNNACGTATGCCA | 6264 |
| TGCAGGACCAGAGAATTCGAATACAA TTGTCCCNNNACGTATGCCA | 5785 | TGCAGGACCAGAGAATTCGAATACAC GATCCAANNNACGTATGCCA | 6025 | TGCAGGACCAGAGAATTCGAATACAA GTTAATCNNNACGTATGCCA | 6265 |
| TGCAGGACCAGAGAATTCGAATACAC GTCGACGNNNACGTATGCCA | 5786 | TGCAGGACCAGAGAATTCGAATACAC TCGGTGGNNNACGTATGCCA | 6026 | TGCAGGACCAGAGAATTCGAATACAG ACTCTAGNNNACGTATGCCA | 6266 |
| TGCAGGACCAGAGAATTCGAATACAC CCGCTCANNNACGTATGCCA | 5787 | TGCAGGACCAGAGAATTCGAATACAG AGATTAANNNACGTATGCCA | 6027 | TGCAGGACCAGAGAATTCGAATACAA GGAAAAANNNACGTATGCCA | 6267 |
| TGCAGGACCAGAGAATTCGAATACAA TGGACTCNNNACGTATGCCA | 5788 | TGCAGGACCAGAGAATTCGAATACAA TCAGGCTNNNACGTATGCCA | 6028 | TGCAGGACCAGAGAATTCGAATACAT GACTAGCNNNACGTATGCCA | 6268 |
| TGCAGGACCAGAGAATTCGAATACAT TGTAACANNNACGTATGCCA | 5789 | TGCAGGACCAGAGAATTCGAATACAG CGGCCCGNNNACGTATGCCA | 6029 | TGCAGGACCAGAGAATTCGAATACAC ATCGTAGNNNACGTATGCCA | 6269 |
| TGCAGGACCAGAGAATTCGAATACAG TTTACTTNNNACGTATGCCA | 5790 | TGCAGGACCAGAGAATTCGAATACAT TTAAATANNNACGTATGCCA | 6030 | TGCAGGACCAGAGAATTCGAATACAA GGTGTTCNNNACGTATGCCA | 6270 |
| TGCAGGACCAGAGAATTCGAATACAT GGATAAANNNACGTATGCCA | 5791 | TGCAGGACCAGAGAATTCGAATACAC ATGGCGCNNNACGTATGCCA | 6031 | TGCAGGACCAGAGAATTCGAATACAG CCATTAGNNNACGTATGCCA | 6271 |
| TGCAGGACCAGAGAATTCGAATACAA TCCTTTGNNNACGTATGCCA | 5792 | TGCAGGACCAGAGAATTCGAATACAT CCGGTTAGNNNACGTATGCCA | 6032 | TGCAGGACCAGAGAATTCGAATACAC GTTCTGTNNNACGTATGCCA | 6272 |
| TGCAGGACCAGAGAATTCGAATACAC GCATACANNNACGTATGCCA | 5793 | TGCAGGACCAGAGAATTCGAATACAC GGCTGANNNACGTATGCCA | 6033 | TGCAGGACCAGAGAATTCGAATACAT CCGCTGNNNACGTATGCCA | 6273 |
| TGCAGGACCAGAGAATTCGAATACAA CACCGATNNNACGTATGCCA | 5794 | TGCAGGACCAGAGAATTCGAATACAT TCCTGTGNNNACGTATGCCA | 6034 | TGCAGGACCAGAGAATTCGAATACAC CTACACTNNNACGTATGCCA | 6274 |
| TGCAGGACCAGAGAATTCGAATACAA TTGCTCCNNNACGTATGCCA | 5795 | TGCAGGACCAGAGAATTCGAATACAG GCGCCTANNNACGTATGCCA | 6035 | TGCAGGACCAGAGAATTCGAATACAA GAAGATTNNNACGTATGCCA | 6275 |
| TGCAGGACCAGAGAATTCGAATACAA TCTTCTANNNACGTATGCCA | 5796 | TGCAGGACCAGAGAATTCGAATACAC CCGCCGGNNNACGTATGCCA | 6036 | TGCAGGACCAGAGAATTCGAATACAA GTCCTTCNNNACGTATGCCA | 6276 |
| TGCAGGACCAGAGAATTCGAATACAT CGAAATTNNNACGTATGCCA | 5797 | TGCAGGACCAGAGAATTCGAATACAA TTCGGCANNNACGTATGCCA | 6037 | TGCAGGACCAGAGAATTCGAATACAG CATTATANNNACGTATGCCA | 6277 |
| TGCAGGACCAGAGAATTCGAATACAC AAGTCACNNNACGTATGCCA | 5798 | TGCAGGACCAGAGAATTCGAATACAC BAATGANNNACGTATGCCA | 6038 | TGCAGGACCAGAGAATTCGAATACAG TGGCATTNNNACGTATGCCA | 6278 |
| TGCAGGACCAGAGAATTCGAATACAT GACCCGGNNNACGTATGCCA | 5799 | TGCAGGACCAGAGAATTCGAATACAT AGGATGGNNNACGTATGCCA | 6039 | TGCAGGACCAGAGAATTCGAATACAA ACGTCACNNNACGTATGCCA | 6279 |
| TGCAGGACCAGAGAATTCGAATACAA GCTGCCGNNNACGTATGCCA | 5800 | TGCAGGACCAGAGAATTCGAATACAT TGGACGTNNNACGTATGCCA | 6040 | TGCAGGACCAGAGAATTCGAATACAG TTAACTANNNACGTATGCCA | 6280 |

FIG. 20B

| Pool-25 | SEQ ID NO: | Pool-26 | SEQ ID NO: | Pool-27 | SEQ ID NO: |
|---|---|---|---|---|---|
| TGCAGGACCAGAGAATTCGAATACATCACTCGTNNNACGTATGCCA | 5801 | TGCAGGACCAGAGAATTCGAATACATCGTGAGTNNNACGTATGCCA | 6041 | TGCAGGACCAGAGAATTCGAATACATAAAGATGNNNACGTATGCCA | 6281 |
| TGCAGGACCAGAGAATTCGAATACAGTTACCGANNNACGTATGCCA | 5802 | TGCAGGACCAGAGAATTCGAATACAGGAACTTCNNNACGTATGCCA | 6042 | TGCAGGACCAGAGAATTCGAATACAAATTTCCTNNNACGTATGCCA | 6282 |
| TGCAGGACCAGAGAATTCGAATACACTTAGATANNNACGTATGCCA | 5803 | TGCAGGACCAGAGAATTCGAATACAATGTGCCANNNACGTATGCCA | 6043 | TGCAGGACCAGAGAATTCGAATACACGGCAAAANNNACGTATGCCA | 6283 |
| TGCAGGACCAGAGAATTCGAATACAAGGCTAGANNNACGTATGCCA | 5804 | TGCAGGACCAGAGAATTCGAATACACCGGTGCANNNACGTATGCCA | 6044 | TGCAGGACCAGAGAATTCGAATACATCGCACAANNNACGTATGCCA | 6284 |
| TGCAGGACCAGAGAATTCGAATACATCACAGGTNNNACGTATGCCA | 5805 | TGCAGGACCAGAGAATTCGAATACACTATTGCCNNNACGTATGCCA | 6045 | TGCAGGACCAGAGAATTCGAATACAAGGTCGCCNNNACGTATGCCA | 6285 |
| TGCAGGACCAGAGAATTCGAATACATATATTTNNNACGTATGCCA | 5806 | TGCAGGACCAGAGAATTCGAATACATTAAGGCCNNNACGTATGCCA | 6046 | TGCAGGACCAGAGAATTCGAATACAGGATTCGTNNNACGTATGCCA | 6286 |
| TGCAGGACCAGAGAATTCGAATACATTGTGTTTNNNACGTATGCCA | 5807 | TGCAGGACCAGAGAATTCGAATACATGTTAAACNNNACGTATGCCA | 6047 | TGCAGGACCAGAGAATTCGAATACAAGCATCTGNNNACGTATGCCA | 6287 |
| TGCAGGACCAGAGAATTCGAATACAGAAAAAAGNNNACGTATGCCA | 5808 | TGCAGGACCAGAGAATTCGAATACACTTGGTTCNNNACGTATGCCA | 6048 | TGCAGGACCAGAGAATTCGAATACACCCACAAANNNACGTATGCCA | 6288 |
| TGCAGGACCAGAGAATTCGAATACAGGCATGTTNNNACGTATGCCA | 5809 | TGCAGGACCAGAGAATTCGAATACAGGTAATTTNNNACGTATGCCA | 6049 | TGCAGGACCAGAGAATTCGAATACAAGTTATACNNNACGTATGCCA | 6289 |
| TGCAGGACCAGAGAATTCGAATACAGGCTTTTCNNNACGTATGCCA | 5810 | TGCAGGACCAGAGAATTCGAATACAATTATCAGNNNACGTATGCCA | 6050 | TGCAGGACCAGAGAATTCGAATACATCTATCATNNNACGTATGCCA | 6290 |
| TGCAGGACCAGAGAATTCGAATACAACTAATACNNNACGTATGCCA | 5811 | TGCAGGACCAGAGAATTCGAATACATGCGTTCTNNNACGTATGCCA | 6051 | TGCAGGACCAGAGAATTCGAATACACGGCTCTCNNNACGTATGCCA | 6291 |
| TGCAGGACCAGAGAATTCGAATACAGTAGCCCGNNNACGTATGCCA | 5812 | TGCAGGACCAGAGAATTCGAATACATGATCCAGNNNACGTATGCCA | 6052 | TGCAGGACCAGAGAATTCGAATACAGTGATTATNNNACGTATGCCA | 6292 |
| TGCAGGACCAGAGAATTCGAATACATAACGTCNNNACGTATGCCA | 5813 | TGCAGGACCAGAGAATTCGAATACACAGTTCAGNNNACGTATGCCA | 6053 | TGCAGGACCAGAGAATTCGAATACATAGACTCGNNNACGTATGCCA | 6293 |
| TGCAGGACCAGAGAATTCGAATACATTTCAAGANNNACGTATGCCA | 5814 | TGCAGGACCAGAGAATTCGAATACATGCGACATNNNACGTATGCCA | 6054 | TGCAGGACCAGAGAATTCGAATACAAACGTTTANNNACGTATGCCA | 6294 |
| TGCAGGACCAGAGAATTCGAATACACACAAGAGNNNACGTATGCCA | 5815 | TGCAGGACCAGAGAATTCGAATACACGCAGTAGNNNACGTATGCCA | 6055 | TGCAGGACCAGAGAATTCGAATACAAAGTAAGTNNNACGTATGCCA | 6295 |
| TGCAGGACCAGAGAATTCGAATACACCCGTTTANNNACGTATGCCA | 5816 | TGCAGGACCAGAGAATTCGAATACATTAGTGATNNNACGTATGCCA | 6056 | TGCAGGACCAGAGAATTCGAATACAATGTTAACNNNACGTATGCCA | 6296 |
| TGCAGGACCAGAGAATTCGAATACAGTTAAGAANNNACGTATGCCA | 5817 | TGCAGGACCAGAGAATTCGAATACACACATTAANNNACGTATGCCA | 6057 | TGCAGGACCAGAGAATTCGAATACATAATCACANNNACGTATGCCA | 6297 |
| TGCAGGACCAGAGAATTCGAATACAGAACCTACNNNACGTATGCCA | 5818 | TGCAGGACCAGAGAATTCGAATACAAGGTGCCCNNNACGTATGCCA | 6058 | TGCAGGACCAGAGAATTCGAATACACATGCTTCNNNACGTATGCCA | 6298 |
| TGCAGGACCAGAGAATTCGAATACAAGCGACTTNNNACGTATGCCA | 5819 | TGCAGGACCAGAGAATTCGAATACAACCTGGCGNNNACGTATGCCA | 6059 | TGCAGGACCAGAGAATTCGAATACAAGCATTATNNNACGTATGCCA | 6299 |
| TGCAGGACCAGAGAATTCGAATACACGCACTAANNNACGTATGCCA | 5820 | TGCAGGACCAGAGAATTCGAATACACGGCGATCNNNACGTATGCCA | 6060 | TGCAGGACCAGAGAATTCGAATACAAGGCATAGNNNACGTATGCCA | 6300 |
| TGCAGGACCAGAGAATTCGAATACAGGTGTTCANNNACGTATGCCA | 5821 | TGCAGGACCAGAGAATTCGAATACATAGACCTGNNNACGTATGCCA | 6061 | TGCAGGACCAGAGAATTCGAATACACATACGCANNNACGTATGCCA | 6301 |
| TGCAGGACCAGAGAATTCGAATACAGTTTTCAANNNACGTATGCCA | 5822 | TGCAGGACCAGAGAATTCGAATACAAGACTACCNNNACGTATGCCA | 6062 | TGCAGGACCAGAGAATTCGAATACAAGACCCGCNNNACGTATGCCA | 6302 |
| TGCAGGACCAGAGAATTCGAATACAGATTCATANNNACGTATGCCA | 5823 | TGCAGGACCAGAGAATTCGAATACACTTAGACGNNNACGTATGCCA | 6063 | TGCAGGACCAGAGAATTCGAATACATTCCCTAGNNNACGTATGCCA | 6303 |
| TGCAGGACCAGAGAATTCGAATACATTGACGACNNNACGTATGCCA | 5824 | TGCAGGACCAGAGAATTCGAATACACGGCGGCCNNNACGTATGCCA | 6064 | TGCAGGACCAGAGAATTCGAATACAAGTGTGCTNNNACGTATGCCA | 6304 |
| TGCAGGACCAGAGAATTCGAATACACCTTGTACNNNACGTATGCCA | 5825 | TGCAGGACCAGAGAATTCGAATACAGCCGATATNNNACGTATGCCA | 6065 | TGCAGGACCAGAGAATTCGAATACACCTGTACTNNNACGTATGCCA | 6305 |
| TGCAGGACCAGAGAATTCGAATACAGGTGCGANNNACGTATGCCA | 5826 | TGCAGGACCAGAGAATTCGAATACACCCGGCCCNNNACGTATGCCA | 6066 | TGCAGGACCAGAGAATTCGAATACACACACCCCNNNACGTATGCCA | 6306 |
| TGCAGGACCAGAGAATTCGAATACATCATGAATNNNACGTATGCCA | 5827 | TGCAGGACCAGAGAATTCGAATACACCTCGCTGNNNACGTATGCCA | 6067 | TGCAGGACCAGAGAATTCGAATACATTTGGTGNNNACGTATGCCA | 6307 |
| TGCAGGACCAGAGAATTCGAATACAGCGAAAGTNNNACGTATGCCA | 5828 | TGCAGGACCAGAGAATTCGAATACACAGCCATANNNACGTATGCCA | 6068 | TGCAGGACCAGAGAATTCGAATACAGTTAGCCANNNACGTATGCCA | 6308 |
| TGCAGGACCAGAGAATTCGAATACAAAATAATNNNCTAGCGTTAC | 5829 | TGCAGGACCAGAGAATTCGAATACAATGGAGCNNNCTAGCGTTAC | 6069 | TGCAGGACCAGAGAATTCGAATACACGACACTNNNCTAGCGTTAC | 6309 |
| TGCAGGACCAGAGAATTCGAATACATTCGTGTCNNNCTAGCGTTAC | 5830 | TGCAGGACCAGAGAATTCGAATACATCACAGACNNNCTAGCGTTAC | 6070 | TGCAGGACCAGAGAATTCGAATACAGCATGACTNNNCTAGCGTTAC | 6310 |
| TGCAGGACCAGAGAATTCGAATACACGTCTTGNNNCTAGCGTTAC | 5831 | TGCAGGACCAGAGAATTCGAATACATCCGTCCGNNNCTAGCGTTAC | 6071 | TGCAGGACCAGAGAATTCGAATACATAGTTGTANNNCTAGCGTTAC | 6311 |
| TGCAGGACCAGAGAATTCGAATACAGACTGTGTNNNCTAGCGTTAC | 5832 | TGCAGGACCAGAGAATTCGAATACAGAATGGACNNNCTAGCGTTAC | 6072 | TGCAGGACCAGAGAATTCGAATACACCTGTTCANNNCTAGCGTTAC | 6312 |
| TGCAGGACCAGAGAATTCGAATACACCATTGGANNNCTAGCGTTAC | 5833 | TGCAGGACCAGAGAATTCGAATACAGTGCTCAANNNCTAGCGTTAC | 6073 | TGCAGGACCAGAGAATTCGAATACACTGAGTCANNNCTAGCGTTAC | 6313 |

FIG. 20C

| Pool-25 | SEQ ID NO: | Pool-26 | SEQ ID NO: | Pool-27 | SEQ ID NO: |
|---|---|---|---|---|---|
| TGCAGGACCAGAGAATTCGAATACACACAGCGCNNNCTAGCGTTAC | 5834 | TGCAGGACCAGAGAATTCGAATACATGTTCGGANNNCTAGCGTTAC | 6074 | TGCAGGACCAGAGAATTCGAATACATCATCTTANNNCTAGCGTTAC | 6314 |
| TGCAGGACCAGAGAATTCGAATACAACCCGTCNNNCTAGCGTTAC | 5835 | TGCAGGACCAGAGAATTCGAATACACTGCGTGGNNNCTAGCGTTAC | 6075 | TGCAGGACCAGAGAATTCGAATACACACATTTNNNCTAGCGTTAC | 6315 |
| TGCAGGACCAGAGAATTCGAATACATCACCTTGNNNCTAGCGTTAC | 5836 | TGCAGGACCAGAGAATTCGAATACAACCGTCAANNNCTAGCGTTAC | 6076 | TGCAGGACCAGAGAATTCGAATACAGCCACATANNNCTAGCGTTAC | 6316 |
| TGCAGGACCAGAGAATTCGAATACAAGTACCACNNNCTAGCGTTAC | 5837 | TGCAGGACCAGAGAATTCGAATACAGGTAACGANNNCTAGCGTTAC | 6077 | TGCAGGACCAGAGAATTCGAATACATAAACAGANNNCTAGCGTTAC | 6317 |
| TGCAGGACCAGAGAATTCGAATACAACAAATGANNNCTAGCGTTAC | 5838 | TGCAGGACCAGAGAATTCGAATACAATCCGAGTNNNCTAGCGTTAC | 6078 | TGCAGGACCAGAGAATTCGAATACAGGTACCATNNNCTAGCGTTAC | 6318 |
| TGCAGGACCAGAGAATTCGAATACAATTGTTGANNNCTAGCGTTAC | 5839 | TGCAGGACCAGAGAATTCGAATACAACCAACCANNNCTAGCGTTAC | 6079 | TGCAGGACCAGAGAATTCGAATACAAGAAAAGNNNCTAGCGTTAC | 6319 |
| TGCAGGACCAGAGAATTCGAATACAACCGAAACNNNCTAGCGTTAC | 5840 | TGCAGGACCAGAGAATTCGAATACACAGTATATNNNCTAGCGTTAC | 6080 | TGCAGGACCAGAGAATTCGAATACAGCTCTCATNNNCTAGCGTTAC | 6320 |
| TGCAGGACCAGAGAATTCGAATACAGAGAACGTNNNCTAGCGTTAC | 5841 | TGCAGGACCAGAGAATTCGAATACATCCGATAGNNNCTAGCGTTAC | 6081 | TGCAGGACCAGAGAATTCGAATACAAGGCACAANNNCTAGCGTTAC | 6321 |
| TGCAGGACCAGAGAATTCGAATACATACCATGGNNNCTAGCGTTAC | 5842 | TGCAGGACCAGAGAATTCGAATACATTAGTATGNNNCTAGCGTTAC | 6082 | TGCAGGACCAGAGAATTCGAATACAGCGATGAANNNCTAGCGTTAC | 6322 |
| TGCAGGACCAGAGAATTCGAATACACAAAACGNNNCTAGCGTTAC | 5843 | TGCAGGACCAGAGAATTCGAATACAACATTCAANNNCTAGCGTTAC | 6083 | TGCAGGACCAGAGAATTCGAATACATCACTTATNNNCTAGCGTTAC | 6323 |
| TGCAGGACCAGAGAATTCGAATACATAGTGAGGNNNCTAGCGTTAC | 5844 | TGCAGGACCAGAGAATTCGAATACAGTACTGACNNNCTAGCGTTAC | 6084 | TGCAGGACCAGAGAATTCGAATACATAGGCCCGNNNCTAGCGTTAC | 6324 |
| TGCAGGACCAGAGAATTCGAATACACGTGATACNNNCTAGCGTTAC | 5845 | TGCAGGACCAGAGAATTCGAATACACCTCATTGNNNCTAGCGTTAC | 6085 | TGCAGGACCAGAGAATTCGAATACAATTTAAATNNNCTAGCGTTAC | 6325 |
| TGCAGGACCAGAGAATTCGAATACACTGCCCCTNNNCTAGCGTTAC | 5846 | TGCAGGACCAGAGAATTCGAATACAATGGCACTNNNCTAGCGTTAC | 6086 | TGCAGGACCAGAGAATTCGAATACATCTGTTTANNNCTAGCGTTAC | 6326 |
| TGCAGGACCAGAGAATTCGAATACAGGACAGTANNNCTAGCGTTAC | 5847 | TGCAGGACCAGAGAATTCGAATACACCCCACGTNNNCTAGCGTTAC | 6087 | TGCAGGACCAGAGAATTCGAATACAAGTTGAAANNNCTAGCGTTAC | 6327 |
| TGCAGGACCAGAGAATTCGAATACACTAGTATANNNCTAGCGTTAC | 5848 | TGCAGGACCAGAGAATTCGAATACACAAACCTGNNNCTAGCGTTAC | 6088 | TGCAGGACCAGAGAATTCGAATACAATATGACTNNNCTAGCGTTAC | 6328 |
| TGCAGGACCAGAGAATTCGAATACAGAACCTTGNNNCTAGCGTTAC | 5849 | TGCAGGACCAGAGAATTCGAATACACGGCCAGTNNNCTAGCGTTAC | 6089 | TGCAGGACCAGAGAATTCGAATACAGAAGACTGNNNCTAGCGTTAC | 6329 |
| TGCAGGACCAGAGAATTCGAATACACTGTTTATNNNCTAGCGTTAC | 5850 | TGCAGGACCAGAGAATTCGAATACAGACAACCTNNNCTAGCGTTAC | 6090 | TGCAGGACCAGAGAATTCGAATACAGTGCGTGCNNNCTAGCGTTAC | 6330 |
| TGCAGGACCAGAGAATTCGAATACAAATACGATNNNCTAGCGTTAC | 5851 | TGCAGGACCAGAGAATTCGAATACATGGCACATNNNCTAGCGTTAC | 6091 | TGCAGGACCAGAGAATTCGAATACAATGTCCGANNNCTAGCGTTAC | 6331 |
| TGCAGGACCAGAGAATTCGAATACACGTCAAGTNNNCTAGCGTTAC | 5852 | TGCAGGACCAGAGAATTCGAATACACCAAGTACNNNCTAGCGTTAC | 6092 | TGCAGGACCAGAGAATTCGAATACATGTTATAGNNNCTAGCGTTAC | 6332 |
| TGCAGGACCAGAGAATTCGAATACACCTGTTTCNNNCTAGCGTTAC | 5853 | TGCAGGACCAGAGAATTCGAATACACACGACCGNNNCTAGCGTTAC | 6093 | TGCAGGACCAGAGAATTCGAATACATGTCGTAGNNNCTAGCGTTAC | 6333 |
| TGCAGGACCAGAGAATTCGAATACAACCGTGCGNNNCTAGCGTTAC | 5854 | TGCAGGACCAGAGAATTCGAATACACCGTGATANNNCTAGCGTTAC | 6094 | TGCAGGACCAGAGAATTCGAATACAGACGCTTANNNCTAGCGTTAC | 6334 |
| TGCAGGACCAGAGAATTCGAATACAAGCTGCGNNNCTAGCGTTAC | 5855 | TGCAGGACCAGAGAATTCGAATACACATTGCCTNNNCTAGCGTTAC | 6095 | TGCAGGACCAGAGAATTCGAATACAGAATTACTNNNCTAGCGTTAC | 6335 |
| TGCAGGACCAGAGAATTCGAATACATCCTTACGNNNCTAGCGTTAC | 5856 | TGCAGGACCAGAGAATTCGAATACATGTTGTTNNNCTAGCGTTAC | 6096 | TGCAGGACCAGAGAATTCGAATACATCGACCCCNNNCTAGCGTTAC | 6336 |
| TGCAGGACCAGAGAATTCGAATACAAACGAAGCNNNCTAGCGTTAC | 5857 | TGCAGGACCAGAGAATTCGAATACATGTTTTGNNNCTAGCGTTAC | 6097 | TGCAGGACCAGAGAATTCGAATACAGCCTCCACNNNCTAGCGTTAC | 6337 |
| TGCAGGACCAGAGAATTCGAATACAGAAGTTTTNNNCTAGCGTTAC | 5858 | TGCAGGACCAGAGAATTCGAATACAGCTCCTCGNNNCTAGCGTTAC | 6098 | TGCAGGACCAGAGAATTCGAATACACTGTATANNNCTAGCGTTAC | 6338 |
| TGCAGGACCAGAGAATTCGAATACAGCCGTTAANNNCTAGCGTTAC | 5859 | TGCAGGACCAGAGAATTCGAATACACCACCTGCNNNCTAGCGTTAC | 6099 | TGCAGGACCAGAGAATTCGAATACATTCGAGTGNNNCTAGCGTTAC | 6339 |
| TGCAGGACCAGAGAATTCGAATACATGTGCCAANNNCTAGCGTTAC | 5860 | TGCAGGACCAGAGAATTCGAATACAGAGCGGTGNNNCTAGCGTTAC | 6100 | TGCAGGACCAGAGAATTCGAATACATAAGTGCCNNNCTAGCGTTAC | 6340 |
| TGCAGGACCAGAGAATTCGAATACAGCAAAACGNNNCTAGCGTTAC | 5861 | TGCAGGACCAGAGAATTCGAATACAAACAACGGNNNCTAGCGTTAC | 6101 | TGCAGGACCAGAGAATTCGAATACACAGATAAANNNCTAGCGTTAC | 6341 |
| TGCAGGACCAGAGAATTCGAATACACGTAAGAGNNNCTAGCGTTAC | 5862 | TGCAGGACCAGAGAATTCGAATACAATTGCTTTNNNCTAGCGTTAC | 6102 | TGCAGGACCAGAGAATTCGAATACAGAATCACNNNCTAGCGTTAC | 6342 |
| TGCAGGACCAGAGAATTCGAATACATGACGTCANNNCTAGCGTTAC | 5863 | TGCAGGACCAGAGAATTCGAATACACCAGAGAANNNCTAGCGTTAC | 6103 | TGCAGGACCAGAGAATTCGAATACAGAGCTTACNNNCTAGCGTTAC | 6343 |
| TGCAGGACCAGAGAATTCGAATACACTCCCTAANNNCTAGCGTTAC | 5864 | TGCAGGACCAGAGAATTCGAATACAGATACCTGNNNCTAGCGTTAC | 6104 | TGCAGGACCAGAGAATTCGAATACATCATCTCCNNNCTAGCGTTAC | 6344 |
| TGCAGGACCAGAGAATTCGAATACATATTCAGANNNCTAGCGTTAC | 5865 | TGCAGGACCAGAGAATTCGAATACAACTTATTCNNNCTAGCGTTAC | 6105 | TGCAGGACCAGAGAATTCGAATACACCACGTGGNNNCTAGCGTTAC | 6345 |
| TGCAGGACCAGAGAATTCGAATACACTAGCAACNNNCTAGCGTTAC | 5866 | TGCAGGACCAGAGAATTCGAATACAAGTTGTTANNNCTAGCGTTAC | 6106 | TGCAGGACCAGAGAATTCGAATACACTGTATGNNNCTAGCGTTAC | 6346 |

FIG. 20D

| Pool-25 | SEQ ID NO: | Pool-26 | SEQ ID NO: | Pool-27 | SEQ ID NO: |
|---|---|---|---|---|---|
| TGCAGGACCAGAGAATTCGAATACAGAATGCCTNNNCTAGCGTTAC | 5867 | TGCAGGACCAGAGAATTCGAATACAATGACTGCNNNCTAGCGTTAC | 6107 | TGCAGGACCAGAGAATTCGAATACACTCTCCGGNNNCTAGCGTTAC | 6347 |
| TGCAGGACCAGAGAATTCGAATACAGACTTCTCNNNCTAGCGTTAC | 5868 | TGCAGGACCAGAGAATTCGAATACAAGCAAACGNNNCTAGCGTTAC | 6108 | TGCAGGACCAGAGAATTCGAATACACAAGAGTGNNNCTAGCGTTAC | 6348 |
| TGCAGGACCAGAGAATTCGAATACATAATTAGCNNNCTAGCGTTAC | 5869 | TGCAGGACCAGAGAATTCGAATACAAGACTATTNNNCTAGCGTTAC | 6109 | TGCAGGACCAGAGAATTCGAATACATAGCTCTCNNNCTAGCGTTAC | 6349 |
| TGCAGGACCAGAGAATTCGAATACACGTGTGGCNNNCTAGCGTTAC | 5870 | TGCAGGACCAGAGAATTCGAATACACTGAAACCNNNCTAGCGTTAC | 6110 | TGCAGGACCAGAGAATTCGAATACAGTGGCAGGNNNCTAGCGTTAC | 6350 |
| TGCAGGACCAGAGAATTCGAATACAGACTCGATNNNCTAGCGTTAC | 5871 | TGCAGGACCAGAGAATTCGAATACAAGCAAAGGNNNCTAGCGTTAC | 6111 | TGCAGGACCAGAGAATTCGAATACATGCATCGANNNCTAGCGTTAC | 6351 |
| TGCAGGACCAGAGAATTCGAATACACCGATCGCNNNCTAGCGTTAC | 5872 | TGCAGGACCAGAGAATTCGAATACACCCTAGTTNNNCTAGCGTTAC | 6112 | TGCAGGACCAGAGAATTCGAATACAGGGTCGANNNNCTAGCGTTAC | 6352 |
| TGCAGGACCAGAGAATTCGAATACAACTCTACCNNNCTAGCGTTAC | 5873 | TGCAGGACCAGAGAATTCGAATACACAAACCACNNNCTAGCGTTAC | 6113 | TGCAGGACCAGAGAATTCGAATACAAAGCCACTNNNCTAGCGTTAC | 6353 |
| TGCAGGACCAGAGAATTCGAATACAGGAAGGCCNNNCTAGCGTTAC | 5874 | TGCAGGACCAGAGAATTCGAATACATTGTAGTANNNCTAGCGTTAC | 6114 | TGCAGGACCAGAGAATTCGAATACAGATCTTTTNNNCTAGCGTTAC | 6354 |
| TGCAGGACCAGAGAATTCGAATACACATATTAGNNNCTAGCGTTAC | 5875 | TGCAGGACCAGAGAATTCGAATACAGTACAGCTNNNCTAGCGTTAC | 6115 | TGCAGGACCAGAGAATTCGAATACAGGCTCTAANNNCTAGCGTTAC | 6355 |
| TGCAGGACCAGAGAATTCGAATACACGGTGACCNNNCTAGCGTTAC | 5876 | TGCAGGACCAGAGAATTCGAATACAAGTGTACCNNNCTAGCGTTAC | 6116 | TGCAGGACCAGAGAATTCGAATACATCTATGTTNNNCTAGCGTTAC | 6356 |
| TGCAGGACCAGAGAATTCGAATACAGTGCATGTNNNCTAGCGTTAC | 5877 | TGCAGGACCAGAGAATTCGAATACATTTTATGCNNNCTAGCGTTAC | 6117 | TGCAGGACCAGAGAATTCGAATACAACCCGCGTGNNNCTAGCGTTAC | 6357 |
| TGCAGGACCAGAGAATTCGAATACATAAGTGTTNNNCTAGCGTTAC | 5878 | TGCAGGACCAGAGAATTCGAATACAAATCGTGNNNCTAGCGTTAC | 6118 | TGCAGGACCAGAGAATTCGAATACAGTACTCGNNNCTAGCGTTAC | 6358 |
| TGCAGGACCAGAGAATTCGAATACAACCTTATTNNNCTAGCGTTAC | 5879 | TGCAGGACCAGAGAATTCGAATACACGATCTGANNNCTAGCGTTAC | 6119 | TGCAGGACCAGAGAATTCGAATACAGGAGCCCTNNNCTAGCGTTAC | 6359 |
| TGCAGGACCAGAGAATTCGAATACAACTCCACTNNNCTAGCGTTAC | 5880 | TGCAGGACCAGAGAATTCGAATACAGATAGATANNNCTAGCGTTAC | 6120 | TGCAGGACCAGAGAATTCGAATACATATCGAGCNNNCTAGCGTTAC | 6360 |
| TGCAGGACCAGAGAATTCGAATACACCAAATATNNNCTAGCGTTAC | 5881 | TGCAGGACCAGAGAATTCGAATACAGAGTCCTANNNCTAGCGTTAC | 6121 | TGCAGGACCAGAGAATTCGAATACACCGTTGAANNNCTAGCGTTAC | 6361 |
| TGCAGGACCAGAGAATTCGAATACACAAGATGGNNNCTAGCGTTAC | 5882 | TGCAGGACCAGAGAATTCGAATACACATGTGGTNNNCTAGCGTTAC | 6122 | TGCAGGACCAGAGAATTCGAATACACGAAGAACNNNCTAGCGTTAC | 6362 |
| TGCAGGACCAGAGAATTCGAATACACCCAAGGCNNNCTAGCGTTAC | 5883 | TGCAGGACCAGAGAATTCGAATACAGATCGCGCNNNCTAGCGTTAC | 6123 | TGCAGGACCAGAGAATTCGAATACAAGTGATCCNNNCTAGCGTTAC | 6363 |
| TGCAGGACCAGAGAATTCGAATACATAAGCGGANNNCTAGCGTTAC | 5884 | TGCAGGACCAGAGAATTCGAATACAACCACATGNNNCTAGCGTTAC | 6124 | TGCAGGACCAGAGAATTCGAATACAGGTCAACTNNNCTAGCGTTAC | 6364 |
| TGCAGGACCAGAGAATTCGAATACAGAGGCCCTNNNCTAGCGTTAC | 5885 | TGCAGGACCAGAGAATTCGAATACATGGCGATANNNCTAGCGTTAC | 6125 | TGCAGGACCAGAGAATTCGAATACATGACGTGTNNNCTAGCGTTAC | 6365 |
| TGCAGGACCAGAGAATTCGAATACACTTCCTAGNNNCTAGCGTTAC | 5886 | TGCAGGACCAGAGAATTCGAATACACAAAGCCTNNNCTAGCGTTAC | 6126 | TGCAGGACCAGAGAATTCGAATACATTACAACANNNCTAGCGTTAC | 6366 |
| TGCAGGACCAGAGAATTCGAATACACGCAGAAANNNCTAGCGTTAC | 5887 | TGCAGGACCAGAGAATTCGAATACAACTGACGTNNNCTAGCGTTAC | 6127 | TGCAGGACCAGAGAATTCGAATACAAAATGTTCNNNCTAGCGTTAC | 6367 |
| TGCAGGACCAGAGAATTCGAATACATGTGCGTANNNCTAGCGTTAC | 5888 | TGCAGGACCAGAGAATTCGAATACAAAGCTGGTNNNCTAGCGTTAC | 6128 | TGCAGGACCAGAGAATTCGAATACATTATAACGNNNCTAGCGTTAC | 6368 |
| TGCAGGACCAGAGAATTCGAATACACGATGGAANNNGATCGACATG | 5889 | TGCAGGACCAGAGAATTCGAATACAGGATCGAANNNGATCGACATG | 6129 | TGCAGGACCAGAGAATTCGAATACATCCCGATANNNGATCGACATG | 6369 |
| TGCAGGACCAGAGAATTCGAATACACCAATTAANNNGATCGACATG | 5890 | TGCAGGACCAGAGAATTCGAATACATCGCAACANNNGATCGACATG | 6130 | TGCAGGACCAGAGAATTCGAATACAAGCCCTTTNNNGATCGACATG | 6370 |
| TGCAGGACCAGAGAATTCGAATACACATAGGCTNNNGATCGACATG | 5891 | TGCAGGACCAGAGAATTCGAATACACCGACTAANNNGATCGACATG | 6131 | TGCAGGACCAGAGAATTCGAATACAGTACACTGNNNGATCGACATG | 6371 |
| TGCAGGACCAGAGAATTCGAATACAAAAAATTNNNGATCGACATG | 5892 | TGCAGGACCAGAGAATTCGAATACAGACCGTTANNNGATCGACATG | 6132 | TGCAGGACCAGAGAATTCGAATACACGTGTAGTNNNGATCGACATG | 6372 |
| TGCAGGACCAGAGAATTCGAATACAATACACTNNNGATCGACATG | 5893 | TGCAGGACCAGAGAATTCGAATACATGCCCTTNNNGATCGACATG | 6133 | TGCAGGACCAGAGAATTCGAATACAGGAAAGTCNNNGATCGACATG | 6373 |
| TGCAGGACCAGAGAATTCGAATACAATCGAAANNNGATCGACATG | 5894 | TGCAGGACCAGAGAATTCGAATACATCGAAACCNNNGATCGACATG | 6134 | TGCAGGACCAGAGAATTCGAATACATTCTGCGTNNNGATCGACATG | 6374 |
| TGCAGGACCAGAGAATTCGAATACATCTATTACNNNGATCGACATG | 5895 | TGCAGGACCAGAGAATTCGAATACAGACCTTCTNNNGATCGACATG | 6135 | TGCAGGACCAGAGAATTCGAATACATACTCGANNNNGATCGACATG | 6375 |
| TGCAGGACCAGAGAATTCGAATACAACCCGATANNNGATCGACATG | 5896 | TGCAGGACCAGAGAATTCGAATACACTACCCTANNNGATCGACATG | 6136 | TGCAGGACCAGAGAATTCGAATACACGTCCAAANNNGATCGACATG | 6376 |
| TGCAGGACCAGAGAATTCGAATACAAAACGCANNNGATCGACATG | 5897 | TGCAGGACCAGAGAATTCGAATACATGCCTTCNNNGATCGACATG | 6137 | TGCAGGACCAGAGAATTCGAATACATTGAACCGNNNGATCGACATG | 6377 |
| TGCAGGACCAGAGAATTCGAATACAGTGATCGTNNNGATCGACATG | 5898 | TGCAGGACCAGAGAATTCGAATACAGCCGACTATNNNGATCGACATG | 6138 | TGCAGGACCAGAGAATTCGAATACAGGCCGCTANNNGATCGACATG | 6378 |
| TGCAGGACCAGAGAATTCGAATACACGCAGCCANNNGATCGACATG | 5899 | TGCAGGACCAGAGAATTCGAATACAGGCATTCANNNGATCGACATG | 6139 | TGCAGGACCAGAGAATTCGAATACAGATACGTCNNNGATCGACATG | 6379 |

FIG. 20E

| Pool-25 | SEQ ID NO: | Pool-26 | SEQ ID NO: | Pool-27 | SEQ ID NO: |
|---|---|---|---|---|---|
| TGCAGGACCAGAGAATTCGAATACATGACCATGNNNGATCGACATG | 5900 | TGCAGGACCAGAGAATTCGAATACAGCTAGAAGNNNGATCGACATG | 6140 | TGCAGGACCAGAGAATTCGAATACAATTCAACANNNGATCGACATG | 6380 |
| TGCAGGACCAGAGAATTCGAATACAGGTCCACGNNNGATCGACATG | 5901 | TGCAGGACCAGAGAATTCGAATACATTTATAAANNNGATCGACATG | 6141 | TGCAGGACCAGAGAATTCGAATACAGTGTGCATNNNGATCGACATG | 6381 |
| TGCAGGACCAGAGAATTCGAATACAAAGCATAANNNGATCGACATG | 5902 | TGCAGGACCAGAGAATTCGAATACATCCCTACANNNGATCGACATG | 6142 | TGCAGGACCAGAGAATTCGAATACAGCCATAGTNNNGATCGACATG | 6382 |
| TGCAGGACCAGAGAATTCGAATACAGACAGGCGNNNGATCGACATG | 5903 | TGCAGGACCAGAGAATTCGAATACAACGTCTAGNNNGATCGACATG | 6143 | TGCAGGACCAGAGAATTCGAATACACTCATCTGNNNGATCGACATG | 6383 |
| TGCAGGACCAGAGAATTCGAATACAACGTAGANNNGATCGACATG | 5904 | TGCAGGACCAGAGAATTCGAATACAGAGCTTTGNNNGATCGACATG | 6144 | TGCAGGACCAGAGAATTCGAATACAAACCGACTNNNGATCGACATG | 6384 |
| TGCAGGACCAGAGAATTCGAATACATCATTACTNNNGATCGACATG | 5905 | TGCAGGACCAGAGAATTCGAATACAAGAGCGGCNNNGATCGACATG | 6145 | TGCAGGACCAGAGAATTCGAATACAAATCGCCCNNNGATCGACATG | 6385 |
| TGCAGGACCAGAGAATTCGAATACACGAAAATANNNGATCGACATG | 5906 | TGCAGGACCAGAGAATTCGAATACACATATACANNNGATCGACATG | 6146 | TGCAGGACCAGAGAATTCGAATACATAGGATCCNNNGATCGACATG | 6386 |
| TGCAGGACCAGAGAATTCGAATACATGGAAGGTNNNGATCGACATG | 5907 | TGCAGGACCAGAGAATTCGAATACAAAGGCTAGNNNGATCGACATG | 6147 | TGCAGGACCAGAGAATTCGAATACAATGGCGTTNNNGATCGACATG | 6387 |
| TGCAGGACCAGAGAATTCGAATACACTGTTTANNNGATCGACATG | 5908 | TGCAGGACCAGAGAATTCGAATACATATCGACGNNNGATCGACATG | 6148 | TGCAGGACCAGAGAATTCGAATACACTAAATTGNNNGATCGACATG | 6388 |
| TGCAGGACCAGAGAATTCGAATACACGGATTGNNNGATCGACATG | 5909 | TGCAGGACCAGAGAATTCGAATACAAGACGTCTNNNGATCGACATG | 6149 | TGCAGGACCAGAGAATTCGAATACAACTACATANNNGATCGACATG | 6389 |
| TGCAGGACCAGAGAATTCGAATACACGTGGTGCNNNGATCGACATG | 5910 | TGCAGGACCAGAGAATTCGAATACATGTTACCCNNNGATCGACATG | 6150 | TGCAGGACCAGAGAATTCGAATACACATCCTCANNNGATCGACATG | 6390 |
| TGCAGGACCAGAGAATTCGAATACAATGCCTCNNNGATCGACATG | 5911 | TGCAGGACCAGAGAATTCGAATACAGCCTGCAGNNNGATCGACATG | 6151 | TGCAGGACCAGAGAATTCGAATACAGATGTGAGNNNGATCGACATG | 6391 |
| TGCAGGACCAGAGAATTCGAATACACGAGAAGGNNNGATCGACATG | 5912 | TGCAGGACCAGAGAATTCGAATACAGGTAACGTNNNGATCGACATG | 6152 | TGCAGGACCAGAGAATTCGAATACAGGGCCAAANNNGATCGACATG | 6392 |
| TGCAGGACCAGAGAATTCGAATACATCATGGTGNNNGATCGACATG | 5913 | TGCAGGACCAGAGAATTCGAATACAATCTTATCNNNGATCGACATG | 6153 | TGCAGGACCAGAGAATTCGAATACACCAAGCTANNNGATCGACATG | 6393 |
| TGCAGGACCAGAGAATTCGAATACACTGGAGCNNNGATCGACATG | 5914 | TGCAGGACCAGAGAATTCGAATACAACGTTTGGNNNGATCGACATG | 6154 | TGCAGGACCAGAGAATTCGAATACAAGGAGATCNNNGATCGACATG | 6394 |
| TGCAGGACCAGAGAATTCGAATACACTGTTAGGNNNGATCGACATG | 5915 | TGCAGGACCAGAGAATTCGAATACAGATTAAAGNNNGATCGACATG | 6155 | TGCAGGACCAGAGAATTCGAATACACCTCCGACNNNGATCGACATG | 6395 |
| TGCAGGACCAGAGAATTCGAATACACTGGTTCTNNNGATCGACATG | 5916 | TGCAGGACCAGAGAATTCGAATACATTGCCAGANNNGATCGACATG | 6156 | TGCAGGACCAGAGAATTCGAATACACGCTGTGGNNNGATCGACATG | 6396 |
| TGCAGGACCAGAGAATTCGAATACACAAAGTCCNNNGATCGACATG | 5917 | TGCAGGACCAGAGAATTCGAATACACGGCATATNNNGATCGACATG | 6157 | TGCAGGACCAGAGAATTCGAATACATACCGCCCNNNGATCGACATG | 6397 |
| TGCAGGACCAGAGAATTCGAATACACGTAGCCGNNNGATCGACATG | 5918 | TGCAGGACCAGAGAATTCGAATACAGGTCAGCCNNNGATCGACATG | 6158 | TGCAGGACCAGAGAATTCGAATACACGTCGCCTNNNGATCGACATG | 6398 |
| TGCAGGACCAGAGAATTCGAATACAAGCTGAANNNGATCGACATG | 5919 | TGCAGGACCAGAGAATTCGAATACACTACCACTNNNGATCGACATG | 6159 | TGCAGGACCAGAGAATTCGAATACACCTCACCGNNNGATCGACATG | 6399 |
| TGCAGGACCAGAGAATTCGAATACACTAATCTTNNNGATCGACATG | 5920 | TGCAGGACCAGAGAATTCGAATACACGCACGGTNNNGATCGACATG | 6160 | TGCAGGACCAGAGAATTCGAATACAGCCTGGACNNNGATCGACATG | 6400 |
| TGCAGGACCAGAGAATTCGAATACAGACTTAATNNNGATCGACATG | 5921 | TGCAGGACCAGAGAATTCGAATACATGCTTCGTNNNGATCGACATG | 6161 | TGCAGGACCAGAGAATTCGAATACAACTTGGACNNNGATCGACATG | 6401 |
| TGCAGGACCAGAGAATTCGAATACAATCACAATNNNGATCGACATG | 5922 | TGCAGGACCAGAGAATTCGAATACAAGCACTGTNNNGATCGACATG | 6162 | TGCAGGACCAGAGAATTCGAATACATGTTGCCTNNNGATCGACATG | 6402 |
| TGCAGGACCAGAGAATTCGAATACAGAGCCTGCNNNGATCGACATG | 5923 | TGCAGGACCAGAGAATTCGAATACACTTACAAANNNGATCGACATG | 6163 | TGCAGGACCAGAGAATTCGAATACACGGCACGTNNNGATCGACATG | 6403 |
| TGCAGGACCAGAGAATTCGAATACACTCTAGGANNNGATCGACATG | 5924 | TGCAGGACCAGAGAATTCGAATACACGATGGCCNNNGATCGACATG | 6164 | TGCAGGACCAGAGAATTCGAATACAAGGTGTGANNNGATCGACATG | 6404 |
| TGCAGGACCAGAGAATTCGAATACAGGTGAGATNNNGATCGACATG | 5925 | TGCAGGACCAGAGAATTCGAATACACACCGCANNNGATCGACATG | 6165 | TGCAGGACCAGAGAATTCGAATACAAACGACGANNNGATCGACATG | 6405 |
| TGCAGGACCAGAGAATTCGAATACAAGGTTGCTNNNGATCGACATG | 5926 | TGCAGGACCAGAGAATTCGAATACAGCCATAACNNNGATCGACATG | 6166 | TGCAGGACCAGAGAATTCGAATACACATCACTCNNNGATCGACATG | 6406 |
| TGCAGGACCAGAGAATTCGAATACAGAGGTGCGNNNGATCGACATG | 5927 | TGCAGGACCAGAGAATTCGAATACATGAAGTCCNNNGATCGACATG | 6167 | TGCAGGACCAGAGAATTCGAATACATAATGCTANNNGATCGACATG | 6407 |
| TGCAGGACCAGAGAATTCGAATACAACTCAGANNNGATCGACATG | 5928 | TGCAGGACCAGAGAATTCGAATACAGCAAACTNNNGATCGACATG | 6168 | TGCAGGACCAGAGAATTCGAATACACGCCTTGCNNNGATCGACATG | 6408 |
| TGCAGGACCAGAGAATTCGAATACACAATGTATNNNGATCGACATG | 5929 | TGCAGGACCAGAGAATTCGAATACAACGCTTCTNNNGATCGACATG | 6169 | TGCAGGACCAGAGAATTCGAATACATGATCAGCNNNGATCGACATG | 6409 |
| TGCAGGACCAGAGAATTCGAATACAAACCATTANNNGATCGACATG | 5930 | TGCAGGACCAGAGAATTCGAATACATACCGGCGNNNGATCGACATG | 6170 | TGCAGGACCAGAGAATTCGAATACACTTCGGAANNNGATCGACATG | 6410 |
| TGCAGGACCAGAGAATTCGAATACATGGCCCTGNNNGATCGACATG | 5931 | TGCAGGACCAGAGAATTCGAATACATGCTAATANNNGATCGACATG | 6171 | TGCAGGACCAGAGAATTCGAATACACGCAAATCNNNGATCGACATG | 6411 |
| TGCAGGACCAGAGAATTCGAATACACGCCCTGTNNNGATCGACATG | 5932 | TGCAGGACCAGAGAATTCGAATACATAAGGAGCNNNGATCGACATG | 6172 | TGCAGGACCAGAGAATTCGAATACAAGAGAACCNNNGATCGACATG | 6412 |

FIG. 20F

| Pool-25 | SEQ ID NO: | Pool-26 | SEQ ID NO: | Pool-27 | SEQ ID NO: |
|---|---|---|---|---|---|
| TGCAGGACCAGAGAATTCGAATACATAGCCGTANNNGATCGACATG | 5933 | TGCAGGACCAGAGAATTCGAATACATAGTCCGANNNGATCGACATG | 6173 | TGCAGGACCAGAGAATTCGAATACATCGACGATNNNGATCGACATG | 6413 |
| TGCAGGACCAGAGAATTCGAATACAGGATAGTGNNNGATCGACATG | 5934 | TGCAGGACCAGAGAATTCGAATACACTATCCTGNNNGATCGACATG | 6174 | TGCAGGACCAGAGAATTCGAATACACAGCAAGANNNGATCGACATG | 6414 |
| TGCAGGACCAGAGAATTCGAATACATAAGGCAGNNNGATCGACATG | 5935 | TGCAGGACCAGAGAATTCGAATACATTTGGTCCNNNGATCGACATG | 6175 | TGCAGGACCAGAGAATTCGAATACACAAAGTAANNNGATCGACATG | 6415 |
| TGCAGGACCAGAGAATTCGAATACAAGGTCCTANNNGATCGACATG | 5936 | TGCAGGACCAGAGAATTCGAATACAGCCTTTCANNNGATCGACATG | 6176 | TGCAGGACCAGAGAATTCGAATACAGAAATCAANNNGATCGACATG | 6416 |
| TGCAGGACCAGAGAATTCGAATACAAACTGGAGNNNGATCGACATG | 5937 | TGCAGGACCAGAGAATTCGAATACAGTGTTCGNNNGATCGACATG | 6177 | TGCAGGACCAGAGAATTCGAATACACTCCTGATNNNGATCGACATG | 6417 |
| TGCAGGACCAGAGAATTCGAATACATTGTTGTTNNNGATCGACATG | 5938 | TGCAGGACCAGAGAATTCGAATACAACTGTCAGNNNGATCGACATG | 6178 | TGCAGGACCAGAGAATTCGAATACAACTATAGTNNNGATCGACATG | 6418 |
| TGCAGGACCAGAGAATTCGAATACAGCGAAGCGNNNGATCGACATG | 5939 | TGCAGGACCAGAGAATTCGAATACAATCTGACGNNNGATCGACATG | 6179 | TGCAGGACCAGAGAATTCGAATACAGGTAGTTCNNNGATCGACATG | 6419 |
| TGCAGGACCAGAGAATTCGAATACAAGATCCGTNNNGATCGACATG | 5940 | TGCAGGACCAGAGAATTCGAATACATACCTCGTNNNGATCGACATG | 6180 | TGCAGGACCAGAGAATTCGAATACACGGAACTTNNNGATCGACATG | 6420 |
| TGCAGGACCAGAGAATTCGAATACAATACCGTGNNNGATCGACATG | 5941 | TGCAGGACCAGAGAATTCGAATACATGCATACGNNNGATCGACATG | 6181 | TGCAGGACCAGAGAATTCGAATACAGGATCTGTNNNGATCGACATG | 6421 |
| TGCAGGACCAGAGAATTCGAATACAAATCATGTNNNGATCGACATG | 5942 | TGCAGGACCAGAGAATTCGAATACACAGGTAAGNNNGATCGACATG | 6182 | TGCAGGACCAGAGAATTCGAATACAATTCCGCTNNNGATCGACATG | 6422 |
| TGCAGGACCAGAGAATTCGAATACATGTTTTGTNNNGATCGACATG | 5943 | TGCAGGACCAGAGAATTCGAATACAGGACCAAANNNGATCGACATG | 6183 | TGCAGGACCAGAGAATTCGAATACATTTCTACANNNGATCGACATG | 6423 |
| TGCAGGACCAGAGAATTCGAATACAGGATACAGNNNGATCGACATG | 5944 | TGCAGGACCAGAGAATTCGAATACAGGTCGCCANNNGATCGACATG | 6184 | TGCAGGACCAGAGAATTCGAATACATCCCACNNNGATCGACATG | 6424 |
| TGCAGGACCAGAGAATTCGAATACAGTTCGTAGNNNGATCGACATG | 5945 | TGCAGGACCAGAGAATTCGAATACAATGGAAGCNNNGATCGACATG | 6185 | TGCAGGACCAGAGAATTCGAATACACTTACCACNNNGATCGACATG | 6425 |
| TGCAGGACCAGAGAATTCGAATACAGGAGATCANNNGATCGACATG | 5946 | TGCAGGACCAGAGAATTCGAATACACATACGACNNNGATCGACATG | 6186 | TGCAGGACCAGAGAATTCGAATACAACCTTCTGNNNGATCGACATG | 6426 |
| TGCAGGACCAGAGAATTCGAATACACTTTGTTANNNGATCGACATG | 5947 | TGCAGGACCAGAGAATTCGAATACATTCAGCGANNNGATCGACATG | 6187 | TGCAGGACCAGAGAATTCGAATACACGTGGTCGNNNGATCGACATG | 6427 |
| TGCAGGACCAGAGAATTCGAATACAGTGAACCTNNNGATCGACATG | 5948 | TGCAGGACCAGAGAATTCGAATACACTGCGGTGNNNGATCGACATG | 6188 | TGCAGGACCAGAGAATTCGAATACACCAAACTGNNNGATCGACATG | 6428 |
| TGCAGGACCAGAGAATTCGAATACACCTACAGANNNTGCATCAGGT | 5949 | TGCAGGACCAGAGAATTCGAATACACAGTACTGNNNTGCATCAGGT | 6189 | TGCAGGACCAGAGAATTCGAATACACTCACGCCNNNTGCATCAGGT | 6429 |
| TGCAGGACCAGAGAATTCGAATACAGCATCGATNNNTGCATCAGGT | 5950 | TGCAGGACCAGAGAATTCGAATACAGATCGAAGNNNTGCATCAGGT | 6190 | TGCAGGACCAGAGAATTCGAATACAGACGAGCGNNNTGCATCAGGT | 6430 |
| TGCAGGACCAGAGAATTCGAATACATACTGCTCNNNTGCATCAGGT | 5951 | TGCAGGACCAGAGAATTCGAATACATCAAACGCNNNTGCATCAGGT | 6191 | TGCAGGACCAGAGAATTCGAATACAAGAATGCCNNNTGCATCAGGT | 6431 |
| TGCAGGACCAGAGAATTCGAATACAGCTGTTGTNNNTGCATCAGGT | 5952 | TGCAGGACCAGAGAATTCGAATACATTTCAATCNNNTGCATCAGGT | 6192 | TGCAGGACCAGAGAATTCGAATACACCAGTCCNNNTGCATCAGGT | 6432 |
| TGCAGGACCAGAGAATTCGAATACAGAGTGCAANNNTGCATCAGGT | 5953 | TGCAGGACCAGAGAATTCGAATACAGAGATGTNNNTGCATCAGGT | 6193 | TGCAGGACCAGAGAATTCGAATACAAAGTATGNNNTGCATCAGGT | 6433 |
| TGCAGGACCAGAGAATTCGAATACATTGACCAGNNNTGCATCAGGT | 5954 | TGCAGGACCAGAGAATTCGAATACAAGGCTCATNNNTGCATCAGGT | 6194 | TGCAGGACCAGAGAATTCGAATACACGTACGTANNNTGCATCAGGT | 6434 |
| TGCAGGACCAGAGAATTCGAATACAATGGTTATNNNTGCATCAGGT | 5955 | TGCAGGACCAGAGAATTCGAATACATGGCCGCANNNTGCATCAGGT | 6195 | TGCAGGACCAGAGAATTCGAATACACAGCGCCANNNTGCATCAGGT | 6435 |
| TGCAGGACCAGAGAATTCGAATACAGCGCTCAGNNNTGCATCAGGT | 5956 | TGCAGGACCAGAGAATTCGAATACATAACTGCGNNNTGCATCAGGT | 6196 | TGCAGGACCAGAGAATTCGAATACAGCTCTCCGNNNTGCATCAGGT | 6436 |
| TGCAGGACCAGAGAATTCGAATACATGGACCCGNNNTGCATCAGGT | 5957 | TGCAGGACCAGAGAATTCGAATACAATCCTTGCNNNTGCATCAGGT | 6197 | TGCAGGACCAGAGAATTCGAATACAGGCCGTACNNNTGCATCAGGT | 6437 |
| TGCAGGACCAGAGAATTCGAATACATTACCACCNNNTGCATCAGGT | 5958 | TGCAGGACCAGAGAATTCGAATACAACTTAATGNNNTGCATCAGGT | 6198 | TGCAGGACCAGAGAATTCGAATACAGAGAGTGTNNNTGCATCAGGT | 6438 |
| TGCAGGACCAGAGAATTCGAATACAGTATAACTNNNTGCATCAGGT | 5959 | TGCAGGACCAGAGAATTCGAATACACACCTGCCNNNTGCATCAGGT | 6199 | TGCAGGACCAGAGAATTCGAATACAATGGAGTGNNNTGCATCAGGT | 6439 |
| TGCAGGACCAGAGAATTCGAATACAGCCCGTGANNNTGCATCAGGT | 5960 | TGCAGGACCAGAGAATTCGAATACATATGCTTTNNNTGCATCAGGT | 6200 | TGCAGGACCAGAGAATTCGAATACATCGGCCGANNNTGCATCAGGT | 6440 |
| TGCAGGACCAGAGAATTCGAATACATGATGACNNNTGCATCAGGT | 5961 | TGCAGGACCAGAGAATTCGAATACACGGTGCAANNNTGCATCAGGT | 6201 | TGCAGGACCAGAGAATTCGAATACAATCGATTANNNTGCATCAGGT | 6441 |
| TGCAGGACCAGAGAATTCGAATACACATGGCATNNNTGCATCAGGT | 5962 | TGCAGGACCAGAGAATTCGAATACACGGCTAATNNNTGCATCAGGT | 6202 | TGCAGGACCAGAGAATTCGAATACACCCAACAANNNTGCATCAGGT | 6442 |
| TGCAGGACCAGAGAATTCGAATACAATGATATCNNNTGCATCAGGT | 5963 | TGCAGGACCAGAGAATTCGAATACATAGCAAAANNNTGCATCAGGT | 6203 | TGCAGGACCAGAGAATTCGAATACATGTAGATTNNNTGCATCAGGT | 6443 |
| TGCAGGACCAGAGAATTCGAATACATGTAAAGNNNTGCATCAGGT | 5964 | TGCAGGACCAGAGAATTCGAATACAAGCAAGCANNNTGCATCAGGT | 6204 | TGCAGGACCAGAGAATTCGAATACAACCGGAGGNNNTGCATCAGGT | 6444 |
| TGCAGGACCAGAGAATTCGAATACACCTTGCCGNNNTGCATCAGGT | 5965 | TGCAGGACCAGAGAATTCGAATACAATAGTACTNNNTGCATCAGGT | 6205 | TGCAGGACCAGAGAATTCGAATACACACCTGAANNNTGCATCAGGT | 6445 |

FIG. 20G

| Pool-25 | SEQ ID NO: | Pool-26 | SEQ ID NO: | Pool-27 | SEQ ID NO: |
|---|---|---|---|---|---|
| TGCAGGACCAGAGAATTCGAATACAGAGGCACGNNNTGCATCAGGT | 5966 | TGCAGGACCAGAGAATTCGAATACACCCATGTTNNNTGCATCAGGT | 6206 | TGCAGGACCAGAGAATTCGAATACAACATGTGCNNNTGCATCAGGT | 6446 |
| TGCAGGACCAGAGAATTCGAATACACCTGAGCGNNNTGCATCAGGT | 5967 | TGCAGGACCAGAGAATTCGAATACAGAGCAATGNNNTGCATCAGGT | 6207 | TGCAGGACCAGAGAATTCGAATACACAGGATCTNNNTGCATCAGGT | 6447 |
| TGCAGGACCAGAGAATTCGAATACAGGTTGCTANNNTGCATCAGGT | 5968 | TGCAGGACCAGAGAATTCGAATACAAATACCTANNNTGCATCAGGT | 6208 | TGCAGGACCAGAGAATTCGAATACACGTTTGTCNNNTGCATCAGGT | 6448 |
| TGCAGGACCAGAGAATTCGAATACAGTCAAAGGNNNTGCATCAGGT | 5969 | TGCAGGACCAGAGAATTCGAATACAAATATTGCNNNTGCATCAGGT | 6209 | TGCAGGACCAGAGAATTCGAATACAAAATCAAGNNNTGCATCAGGT | 6449 |
| TGCAGGACCAGAGAATTCGAATACAACGTATGCNNNTGCATCAGGT | 5970 | TGCAGGACCAGAGAATTCGAATACAAATCCATANNNTGCATCAGGT | 6210 | TGCAGGACCAGAGAATTCGAATACATCAACATANNNTGCATCAGGT | 6450 |
| TGCAGGACCAGAGAATTCGAATACACGAGCGGANNNTGCATCAGGT | 5971 | TGCAGGACCAGAGAATTCGAATACATCCATTTANNNTGCATCAGGT | 6211 | TGCAGGACCAGAGAATTCGAATACAATGAAGGCNNNTGCATCAGGT | 6451 |
| TGCAGGACCAGAGAATTCGAATACATTTTGCCGNNNTGCATCAGGT | 5972 | TGCAGGACCAGAGAATTCGAATACAGAGGTTCTNNNTGCATCAGGT | 6212 | TGCAGGACCAGAGAATTCGAATACACAAGTGGANNNTGCATCAGGT | 6452 |
| TGCAGGACCAGAGAATTCGAATACAGAGTCTGCNNNTGCATCAGGT | 5973 | TGCAGGACCAGAGAATTCGAATACAGTGATACCNNNTGCATCAGGT | 6213 | TGCAGGACCAGAGAATTCGAATACAAGCAAAATNNNTGCATCAGGT | 6453 |
| TGCAGGACCAGAGAATTCGAATACACTTCCTTCNNNTGCATCAGGT | 5974 | TGCAGGACCAGAGAATTCGAATACAACCTTGCTNNNTGCATCAGGT | 6214 | TGCAGGACCAGAGAATTCGAATACACAGATCCNNNTGCATCAGGT | 6454 |
| TGCAGGACCAGAGAATTCGAATACAATGTGAAANNNTGCATCAGGT | 5975 | TGCAGGACCAGAGAATTCGAATACATATCAAGTNNNTGCATCAGGT | 6215 | TGCAGGACCAGAGAATTCGAATACATACGCCTTNNNTGCATCAGGT | 6455 |
| TGCAGGACCAGAGAATTCGAATACACCCGTGGTNNNTGCATCAGGT | 5976 | TGCAGGACCAGAGAATTCGAATACAACTTAGGCNNNTGCATCAGGT | 6216 | TGCAGGACCAGAGAATTCGAATACAAGCGCTANNNTGCATCAGGT | 6456 |
| TGCAGGACCAGAGAATTCGAATACACAGAGGCGNNNTGCATCAGGT | 5977 | TGCAGGACCAGAGAATTCGAATACAACTGTTCCNNNTGCATCAGGT | 6217 | TGCAGGACCAGAGAATTCGAATACAAGTGATGGNNNTGCATCAGGT | 6457 |
| TGCAGGACCAGAGAATTCGAATACATTTGATCTNNNTGCATCAGGT | 5978 | TGCAGGACCAGAGAATTCGAATACAGGATCCATNNNTGCATCAGGT | 6218 | TGCAGGACCAGAGAATTCGAATACACGGATGAANNNTGCATCAGGT | 6458 |
| TGCAGGACCAGAGAATTCGAATACAGCGTCGACNNNTGCATCAGGT | 5979 | TGCAGGACCAGAGAATTCGAATACACCACTCCGNNNTGCATCAGGT | 6219 | TGCAGGACCAGAGAATTCGAATACAGACATAGGNNNTGCATCAGGT | 6459 |
| TGCAGGACCAGAGAATTCGAATACAGATATAANNNTGCATCAGGT | 5980 | TGCAGGACCAGAGAATTCGAATACACCAAGAGTNNNTGCATCAGGT | 6220 | TGCAGGACCAGAGAATTCGAATACAATTGCGTGNNNTGCATCAGGT | 6460 |
| TGCAGGACCAGAGAATTCGAATACAAATTTTANNNTGCATCAGGT | 5981 | TGCAGGACCAGAGAATTCGAATACAACCGTCTTNNNTGCATCAGGT | 6221 | TGCAGGACCAGAGAATTCGAATACACTACAGTGNNNTGCATCAGGT | 6461 |
| TGCAGGACCAGAGAATTCGAATACAAGCCGTGNNNTGCATCAGGT | 5982 | TGCAGGACCAGAGAATTCGAATACAGGCTTAGTNNNTGCATCAGGT | 6222 | TGCAGGACCAGAGAATTCGAATACACCGTCCACNNNTGCATCAGGT | 6462 |
| TGCAGGACCAGAGAATTCGAATACACAATAAAGNNNTGCATCAGGT | 5983 | TGCAGGACCAGAGAATTCGAATACACCTAAGCANNNTGCATCAGGT | 6223 | TGCAGGACCAGAGAATTCGAATACAAAGCCCATNNNTGCATCAGGT | 6463 |
| TGCAGGACCAGAGAATTCGAATACAGCGACATTNNNTGCATCAGGT | 5984 | TGCAGGACCAGAGAATTCGAATACAGCCCGAAGNNNTGCATCAGGT | 6224 | TGCAGGACCAGAGAATTCGAATACACGAGGCCTNNNTGCATCAGGT | 6464 |
| TGCAGGACCAGAGAATTCGAATACACAGAGAGTNNNTGCATCAGGT | 5985 | TGCAGGACCAGAGAATTCGAATACACATTCTTANNNTGCATCAGGT | 6225 | TGCAGGACCAGAGAATTCGAATACAACCTATCCNNNTGCATCAGGT | 6465 |
| TGCAGGACCAGAGAATTCGAATACACTTCACACNNNTGCATCAGGT | 5986 | TGCAGGACCAGAGAATTCGAATACAACTACGGTNNNTGCATCAGGT | 6226 | TGCAGGACCAGAGAATTCGAATACAAGGGCAGCNNNTGCATCAGGT | 6466 |
| TGCAGGACCAGAGAATTCGAATACATTAAGCTANNNTGCATCAGGT | 5987 | TGCAGGACCAGAGAATTCGAATACACCGGAGCTNNNTGCATCAGGT | 6227 | TGCAGGACCAGAGAATTCGAATACAAGAACTGNNNTGCATCAGGT | 6467 |
| TGCAGGACCAGAGAATTCGAATACAGTGACCGCNNNTGCATCAGGT | 5988 | TGCAGGACCAGAGAATTCGAATACAGTACTTAANNNTGCATCAGGT | 6228 | TGCAGGACCAGAGAATTCGAATACATGGTGTTGNNNTGCATCAGGT | 6468 |
| TGCAGGACCAGAGAATTCGAATACACCGTATGNNNTGCATCAGGT | 5989 | TGCAGGACCAGAGAATTCGAATACATGCCGCTCNNNTGCATCAGGT | 6229 | TGCAGGACCAGAGAATTCGAATACACTAAATCANNNTGCATCAGGT | 6469 |
| TGCAGGACCAGAGAATTCGAATACATAGCATTANNNTGCATCAGGT | 5990 | TGCAGGACCAGAGAATTCGAATACAGCGACTTANNNTGCATCAGGT | 6230 | TGCAGGACCAGAGAATTCGAATACAATTTCCGCNNNTGCATCAGGT | 6470 |
| TGCAGGACCAGAGAATTCGAATACACTAGGCCGNNNTGCATCAGGT | 5991 | TGCAGGACCAGAGAATTCGAATACAATGGCAAGNNNTGCATCAGGT | 6231 | TGCAGGACCAGAGAATTCGAATACACCTCCATANNNTGCATCAGGT | 6471 |
| TGCAGGACCAGAGAATTCGAATACATTAGTAACNNNTGCATCAGGT | 5992 | TGCAGGACCAGAGAATTCGAATACACGGAGGTGNNNTGCATCAGGT | 6232 | TGCAGGACCAGAGAATTCGAATACATTACTACTNNNTGCATCAGGT | 6472 |
| TGCAGGACCAGAGAATTCGAATACATATCACGNNNTGCATCAGGT | 5993 | TGCAGGACCAGAGAATTCGAATACAACATTACNNNTGCATCAGGT | 6233 | TGCAGGACCAGAGAATTCGAATACATCGTTTATNNNTGCATCAGGT | 6473 |
| TGCAGGACCAGAGAATTCGAATACAGATTCTCNNNTGCATCAGGT | 5994 | TGCAGGACCAGAGAATTCGAATACATAGGAAATNNNTGCATCAGGT | 6234 | TGCAGGACCAGAGAATTCGAATACATTTCAATGNNNTGCATCAGGT | 6474 |
| TGCAGGACCAGAGAATTCGAATACAGAGGAAGANNNTGCATCAGGT | 5995 | TGCAGGACCAGAGAATTCGAATACACCTAAGTGNNNTGCATCAGGT | 6235 | TGCAGGACCAGAGAATTCGAATACAAACCACACNNNTGCATCAGGT | 6475 |
| TGCAGGACCAGAGAATTCGAATACATGTCTGCTNNNTGCATCAGGT | 5996 | TGCAGGACCAGAGAATTCGAATACATAGACGCTNNNTGCATCAGGT | 6236 | TGCAGGACCAGAGAATTCGAATACATACCCGCCNNNTGCATCAGGT | 6476 |
| TGCAGGACCAGAGAATTCGAATACAAATACTCANNNTGCATCAGGT | 5997 | TGCAGGACCAGAGAATTCGAATACAGTGAAGCANNNTGCATCAGGT | 6237 | TGCAGGACCAGAGAATTCGAATACACCATGGGCNNNTGCATCAGGT | 6477 |
| TGCAGGACCAGAGAATTCGAATACATAGTTCCCNNNTGCATCAGGT | 5998 | TGCAGGACCAGAGAATTCGAATACAGGACGCAGNNNTGCATCAGGT | 6238 | TGCAGGACCAGAGAATTCGAATACACCTGAGTANNNTGCATCAGGT | 6478 |

FIG. 20H

| Pool-25 | SEQ ID NO: | Pool-26 | SEQ ID NO: | Pool-27 | SEQ ID NO: |
|---|---|---|---|---|---|
| TGCAGGACCAGAGAATTCGAATACAAATTCGTANNNTGCATCAGGT | 5999 | TGCAGGACCAGAGAATTCGAATACATTTTACGTNNNTGCATCAGGT | 6239 | TGCAGGACCAGAGAATTCGAATACAGGATGTCTNNNTGCATCAGGT | 6479 |
| TGCAGGACCAGAGAATTCGAATACAGCTGATTGNNNTGCATCAGGT | 6000 | TGCAGGACCAGAGAATTCGAATACAGATGATTTNNNTGCATCAGGT | 6240 | TGCAGGACCAGAGAATTCGAATACAAAGACCCTNNNTGCATCAGGT | 6480 |
| TGCAGGACCAGAGAATTCGAATACATACCCGAANNNTGCATCAGGT | 6001 | TGCAGGACCAGAGAATTCGAATACAACGGAATGNNNTGCATCAGGT | 6241 | TGCAGGACCAGAGAATTCGAATACAGTACTTGGNNNTGCATCAGGT | 6481 |
| TGCAGGACCAGAGAATTCGAATACAAGGCCATTNNNTGCATCAGGT | 6002 | TGCAGGACCAGAGAATTCGAATACAAATGGCAGNNNTGCATCAGGT | 6242 | TGCAGGACCAGAGAATTCGAATACATCCCTCTTNNNTGCATCAGGT | 6482 |
| TGCAGGACCAGAGAATTCGAATACAGCTCCCCANNNTGCATCAGGT | 6003 | TGCAGGACCAGAGAATTCGAATACACGACTGATNNNTGCATCAGGT | 6243 | TGCAGGACCAGAGAATTCGAATACATACTTACTNNNTGCATCAGGT | 6483 |
| TGCAGGACCAGAGAATTCGAATACATGAACGCTNNNTGCATCAGGT | 6004 | TGCAGGACCAGAGAATTCGAATACAAAAGATACNNNTGCATCAGGT | 6244 | TGCAGGACCAGAGAATTCGAATACAGGTTTTCCNNNTGCATCAGGT | 6484 |
| TGCAGGACCAGAGAATTCGAATACACGAGGCAGNNNTGCATCAGGT | 6005 | TGCAGGACCAGAGAATTCGAATACAACGGCATTNNNTGCATCAGGT | 6245 | TGCAGGACCAGAGAATTCGAATACAGGATCACTNNNTGCATCAGGT | 6485 |
| TGCAGGACCAGAGAATTCGAATACAGGTGCTATNNNTGCATCAGGT | 6006 | TGCAGGACCAGAGAATTCGAATACACACGCTCNNNTGCATCAGGT | 6246 | TGCAGGACCAGAGAATTCGAATACATTGATGGCNNNTGCATCAGGT | 6486 |
| TGCAGGACCAGAGAATTCGAATACAAATTGCCGNNNTGCATCAGGT | 6007 | TGCAGGACCAGAGAATTCGAATACAAACCACTGNNNTGCATCAGGT | 6247 | TGCAGGACCAGAGAATTCGAATACACCACATTCNNNTGCATCAGGT | 6487 |
| TGCAGGACCAGAGAATTCGAATACAGGCCGACTNNNTGCATCAGGT | 6008 | TGCAGGACCAGAGAATTCGAATACAGTCGAGTTNNNTGCATCAGGT | 6248 | TGCAGGACCAGAGAATTCGAATACACAAAAAGTNNNTGCATCAGGT | 6488 |

FIG. 21A

| Pool-28 | SEQ ID NO: | Pool-29 | SEQ ID NO: | Pool-30 | SEQ ID NO: |
|---|---|---|---|---|---|
| TGCAGGACCAGAGAATTCGAATA CACAGTATTANNNACGTATGCCA | 6489 | TGCAGGACCAGAGAATTCGAATA CAGCTGACCGNNNACGTATGCCA | 6729 | TGCAGGACCAGAGAATTCGAATA CATATTCGTTNNNACGTATGCCA | 6969 |
| TGCAGGACCAGAGAATTCGAATA CAGTACTAATNNNACGTATGCCA | 6490 | TGCAGGACCAGAGAATTCGAATA CACCAGCATANNNACGTATGCCA | 6730 | TGCAGGACCAGAGAATTCGAATA CACCATTAAANNNACGTATGCCA | 6970 |
| TGCAGGACCAGAGAATTCGAATA CATTTATGCTNNNACGTATGCCA | 6491 | TGCAGGACCAGAGAATTCGAATA CACGAAGGATNNNACGTATGCCA | 6731 | TGCAGGACCAGAGAATTCGAATA CAGTTGGCGCNNNACGTATGCCA | 6971 |
| TGCAGGACCAGAGAATTCGAATA CAGTCATCCTNNNACGTATGCCA | 6492 | TGCAGGACCAGAGAATTCGAATA CACGACGAGGNNNACGTATGCCA | 6732 | TGCAGGACCAGAGAATTCGAATA CACTGGCGTGNNNACGTATGCCA | 6972 |
| TGCAGGACCAGAGAATTCGAATA CACGAATAAANNNACGTATGCCA | 6493 | TGCAGGACCAGAGAATTCGAATA CATATAACCANNNACGTATGCCA | 6733 | TGCAGGACCAGAGAATTCGAATA CAAATACCCGNNNACGTATGCCA | 6973 |
| TGCAGGACCAGAGAATTCGAATA CAGACGTATCNNNACGTATGCCA | 6494 | TGCAGGACCAGAGAATTCGAATA CAGTGGTTPGNNNACGTATGCCA | 6734 | TGCAGGACCAGAGAATTCGAATA CACACAAACCNNNACGTATGCCA | 6974 |
| TGCAGGACCAGAGAATTCGAATA CAAATTCACANNNACGTATGCCA | 6495 | TGCAGGACCAGAGAATTCGAATA CAGTTGCGATNNNACGTATGCCA | 6735 | TGCAGGACCAGAGAATTCGAATA CAATTAATATNNNACGTATGCCA | 6975 |
| TGCAGGACCAGAGAATTCGAATA CAAATCCGCANNNACGTATGCCA | 6496 | TGCAGGACCAGAGAATTCGAATA CAATACCTCNNNACGTATGCCA | 6736 | TGCAGGACCAGAGAATTCGAATA CAGATTAGCCNNNACGTATGCCA | 6976 |
| TGCAGGACCAGAGAATTCGAATA CAACCTATTNNNACGTATGCCA | 6497 | TGCAGGACCAGAGAATTCGAATA CACTCGAAGTNNNACGTATGCCA | 6737 | TGCAGGACCAGAGAATTCGAATA CAGACAAAATNNNACGTATGCCA | 6977 |
| TGCAGGACCAGAGAATTCGAATA CAGCTTACPCNNNACGTATGCCA | 6498 | TGCAGGACCAGAGAATTCGAATA CACAGGCGTANNNACGTATGCCA | 6738 | TGCAGGACCAGAGAATTCGAATA CAAATATTTANNNACGTATGCCA | 6978 |
| TGCAGGACCAGAGAATTCGAATA CATTGGATGCNNNACGTATGCCA | 6499 | TGCAGGACCAGAGAATTCGAATA CAATAGTCATNNNACGTATGCCA | 6739 | TGCAGGACCAGAGAATTCGAATA CAAAAAGTCANNNACGTATGCCA | 6979 |
| TGCAGGACCAGAGAATTCGAATA CAGCGCGGANNNACGTATGCCA | 6500 | TGCAGGACCAGAGAATTCGAATA CACTCGTCGNNNACGTATGCCA | 6740 | TGCAGGACCAGAGAATTCGAATA CAGTCTATATNNNACGTATGCCA | 6980 |
| TGCAGGACCAGAGAATTCGAATA CAACAAGTTNNNACGTATGCCA | 6501 | TGCAGGACCAGAGAATTCGAATA CAGTGCCGTGNNNACGTATGCCA | 6741 | TGCAGGACCAGAGAATTCGAATA CAAAAAACGTNNNACGTATGCCA | 6981 |
| TGCAGGACCAGAGAATTCGAATA CATATCTCATNNNACGTATGCCA | 6502 | TGCAGGACCAGAGAATTCGAATA CAAGTAAAGTNNNACGTATGCCA | 6742 | TGCAGGACCAGAGAATTCGAATA CATTGCTCTGNNNACGTATGCCA | 6982 |
| TGCAGGACCAGAGAATTCGAATA CAGGTTTGGTNNNACGTATGCCA | 6503 | TGCAGGACCAGAGAATTCGAATA CATATTGCAANNNACGTATGCCA | 6743 | TGCAGGACCAGAGAATTCGAATA CAATGATGAANNNACGTATGCCA | 6983 |
| TGCAGGACCAGAGAATTCGAATA CATAATTCCTNNNACGTATGCCA | 6504 | TGCAGGACCAGAGAATTCGAATA CAACCCAGCGNNNACGTATGCCA | 6744 | TGCAGGACCAGAGAATTCGAATA CATCCCTGTANNNACGTATGCCA | 6984 |
| TGCAGGACCAGAGAATTCGAATA CAACGTCGTANNNACGTATGCCA | 6505 | TGCAGGACCAGAGAATTCGAATA CATGTCAAATNNNACGTATGCCA | 6745 | TGCAGGACCAGAGAATTCGAATA CAACATCCGANNNACGTATGCCA | 6985 |
| TGCAGGACCAGAGAATTCGAATA CAGAAGCTAGNNNACGTATGCCA | 6506 | TGCAGGACCAGAGAATTCGAATA CAGTGAAACGNNNACGTATGCCA | 6746 | TGCAGGACCAGAGAATTCGAATA CATTAGATCANNNACGTATGCCA | 6986 |
| TGCAGGACCAGAGAATTCGAATA CAACGAATCCNNNACGTATGCCA | 6507 | TGCAGGACCAGAGAATTCGAATA CAAGGGATANNNACGTATGCCA | 6747 | TGCAGGACCAGAGAATTCGAATA CACGCCTACCNNNACGTATGCCA | 6987 |
| TGCAGGACCAGAGAATTCGAATA CATCTTAATCNNNACGTATGCCA | 6508 | TGCAGGACCAGAGAATTCGAATA CAACCGAGTTNNNACGTATGCCA | 6748 | TGCAGGACCAGAGAATTCGAATA CACTCTAACCNNNACGTATGCCA | 6988 |
| TGCAGGACCAGAGAATTCGAATA CAGCTTTTCGNNNACGTATGCCA | 6509 | TGCAGGACCAGAGAATTCGAATA CATAAGGATANNNACGTATGCCA | 6749 | TGCAGGACCAGAGAATTCGAATA CACGTCATCTNNNACGTATGCCA | 6989 |
| TGCAGGACCAGAGAATTCGAATA CATGCTGAGTNNNACGTATGCCA | 6510 | TGCAGGACCAGAGAATTCGAATA CATAGTGGANNNACGTATGCCA | 6750 | TGCAGGACCAGAGAATTCGAATA CACACCTATCNNNACGTATGCCA | 6990 |
| TGCAGGACCAGAGAATTCGAATA CACGTTGCAANNNACGTATGCCA | 6511 | TGCAGGACCAGAGAATTCGAATA CATGTGGAAGNNNACGTATGCCA | 6751 | TGCAGGACCAGAGAATTCGAATA CATCGCTATCNNNACGTATGCCA | 6991 |
| TGCAGGACCAGAGAATTCGAATA CACAGTACGTNNNACGTATGCCA | 6512 | TGCAGGACCAGAGAATTCGAATA CACCCACGTCNNNACGTATGCCA | 6752 | TGCAGGACCAGAGAATTCGAATA CAGAAGGCCGNNNACGTATGCCA | 6992 |
| TGCAGGACCAGAGAATTCGAATA CATGGATTTANNNACGTATGCCA | 6513 | TGCAGGACCAGAGAATTCGAATA CAGTAACGGANNNACGTATGCCA | 6753 | TGCAGGACCAGAGAATTCGAATA CAGTTTTCGCNNNACGTATGCCA | 6993 |
| TGCAGGACCAGAGAATTCGAATA CAGTGTAGAGNNNACGTATGCCA | 6514 | TGCAGGACCAGAGAATTCGAATA CATTCTACATNNNACGTATGCCA | 6754 | TGCAGGACCAGAGAATTCGAATA CAAGTGGCCNNNACGTATGCCA | 6994 |
| TGCAGGACCAGAGAATTCGAATA CACTTTAGAANNNACGTATGCCA | 6515 | TGCAGGACCAGAGAATTCGAATA CATCAATGATNNNACGTATGCCA | 6755 | TGCAGGACCAGAGAATTCGAATA CAAGCCTACNNNACGTATGCCA | 6995 |
| TGCAGGACCAGAGAATTCGAATA CAATATAGTCNNNACGTATGCCA | 6516 | TGCAGGACCAGAGAATTCGAATA CATCGCGAATNNNACGTATGCCA | 6756 | TGCAGGACCAGAGAATTCGAATA CAATTCGAGNNNACGTATGCCA | 6996 |
| TGCAGGACCAGAGAATTCGAATA CAGTAGAGCANNNACGTATGCCA | 6517 | TGCAGGACCAGAGAATTCGAATA CATAATGACTNNNACGTATGCCA | 6757 | TGCAGGACCAGAGAATTCGAATA CACAACCGATNNNACGTATGCCA | 6997 |
| TGCAGGACCAGAGAATTCGAATA CATAAATAACNNNACGTATGCCA | 6518 | TGCAGGACCAGAGAATTCGAATA CACAGGTTTGNNNACGTATGCCA | 6758 | TGCAGGACCAGAGAATTCGAATA CAAAGTAGANNNACGTATGCCA | 6998 |
| TGCAGGACCAGAGAATTCGAATA CACAGGACAANNNACGTATGCCA | 6519 | TGCAGGACCAGAGAATTCGAATA CATTCGGCTTNNNACGTATGCCA | 6759 | TGCAGGACCAGAGAATTCGAATA CAATCTGCCTNNNACGTATGCCA | 6999 |
| TGCAGGACCAGAGAATTCGAATA CAAATTANNNACGTATGCCA | 6520 | TGCAGGACCAGAGAATTCGAATA CACCCTTATTNNNACGTATGCCA | 6760 | TGCAGGACCAGAGAATTCGAATA CACTCATTANNNACGTATGCCA | 7000 |
| TGCAGGACCAGAGAATTCGAATA CATGAATCATNNNACGTATGCCA | 6521 | TGCAGGACCAGAGAATTCGAATA CATAGCATGCNNNACGTATGCCA | 6761 | TGCAGGACCAGAGAATTCGAATA CATAAATCACNNNACGTATGCCA | 7001 |

FIG. 21B

| Pool-28 | SEQ ID NO: | Pool-29 | SEQ ID NO: | Pool-30 | SEQ ID NO: |
|---|---|---|---|---|---|
| TGCAGGACCAGAGAATTCGAATA CACTACGTAGNNNACGTATGCCA | 6522 | TGCAGGACCAGAGAATTCGAATA CAAAAACGCGNNNACGTATGCCA | 6762 | TGCAGGACCAGAGAATTCGAATA CACCGAGACCNNNACGTATGCCA | 7002 |
| TGCAGGACCAGAGAATTCGAATA CAGTACATCGNNNACGTATGCCA | 6523 | TGCAGGACCAGAGAATTCGAATA CATAGCTGACNNNACGTATGCCA | 6763 | TGCAGGACCAGAGAATTCGAATA CATCCCCACNNNACGTATGCCA | 7003 |
| TGCAGGACCAGAGAATTCGAATA CACCGCAGTGCNNNACGTATGCCA | 6524 | TGCAGGACCAGAGAATTCGAATA CACTACCCCGNNNACGTATGCCA | 6764 | TGCAGGACCAGAGAATTCGAATA CAACGACTTGNNNACGTATGCCA | 7004 |
| TGCAGGACCAGAGAATTCGAATA CAAACAAAGTNNNACGTATGCCA | 6525 | TGCAGGACCAGAGAATTCGAATA CAAGCTGTCANNNACGTATGCCA | 6765 | TGCAGGACCAGAGAATTCGAATA CAGTTTAGCGNNNACGTATGCCA | 7005 |
| TGCAGGACCAGAGAATTCGAATA CAAAACTTCANNNACGTATGCCA | 6526 | TGCAGGACCAGAGAATTCGAATA CACCCTCAGCNNNACGTATGCCA | 6766 | TGCAGGACCAGAGAATTCGAATA CAGTTTCAAANNNACGTATGCCA | 7006 |
| TGCAGGACCAGAGAATTCGAATA CAAGGAGCCGNNNACGTATGCCA | 6527 | TGCAGGACCAGAGAATTCGAATA CACACGTTCTNNNACGTATGCCA | 6767 | TGCAGGACCAGAGAATTCGAATA CAGAATGCGANNNACGTATGCCA | 7007 |
| TGCAGGACCAGAGAATTCGAATA CACGTGACATNNNACGTATGCCA | 6528 | TGCAGGACCAGAGAATTCGAATA CAACGGAACANNNACGTATGCCA | 6768 | TGCAGGACCAGAGAATTCGAATA CAACCCGTAANNNACGTATGCCA | 7008 |
| TGCAGGACCAGAGAATTCGAATA CAATACATCANNNACGTATGCCA | 6529 | TGCAGGACCAGAGAATTCGAATA CAGATCATTANNNACGTATGCCA | 6769 | TGCAGGACCAGAGAATTCGAATA CAGTCACCAANNNACGTATGCCA | 7009 |
| TGCAGGACCAGAGAATTCGAATA CAAATAACCTNNNACGTATGCCA | 6530 | TGCAGGACCAGAGAATTCGAATA CACTAGAACCNNNACGTATGCCA | 6770 | TGCAGGACCAGAGAATTCGAATA CATTGGACTGNNNACGTATGCCA | 7010 |
| TGCAGGACCAGAGAATTCGAATA CACCAGCTTTNNNACGTATGCCA | 6531 | TGCAGGACCAGAGAATTCGAATA CATTTAGGTANNNACGTATGCCA | 6771 | TGCAGGACCAGAGAATTCGAATA CAAAGCTTGANNNACGTATGCCA | 7011 |
| TGCAGGACCAGAGAATTCGAATA CATCCGTTTGNNNACGTATGCCA | 6532 | TGCAGGACCAGAGAATTCGAATA CATGATATTGNNNACGTATGCCA | 6772 | TGCAGGACCAGAGAATTCGAATA CATTATTTATNNNACGTATGCCA | 7012 |
| TGCAGGACCAGAGAATTCGAATA CACAGTCGGCNNNACGTATGCCA | 6533 | TGCAGGACCAGAGAATTCGAATA CAGCGAAAACNNNACGTATGCCA | 6773 | TGCAGGACCAGAGAATTCGAATA CATACAATGNNNACGTATGCCA | 7013 |
| TGCAGGACCAGAGAATTCGAATA CATGATCGGTNNNACGTATGCCA | 6534 | TGCAGGACCAGAGAATTCGAATA CAACTAACGCNNNACGTATGCCA | 6774 | TGCAGGACCAGAGAATTCGAATA CAAAAGTGGCNNNACGTATGCCA | 7014 |
| TGCAGGACCAGAGAATTCGAATA CAACACACACNNNACGTATGCCA | 6535 | TGCAGGACCAGAGAATTCGAATA CATACTTGCCNNNACGTATGCCA | 6775 | TGCAGGACCAGAGAATTCGAATA CAGCTGCTCNNNACGTATGCCA | 7015 |
| TGCAGGACCAGAGAATTCGAATA CATCACGCAANNNACGTATGCCA | 6536 | TGCAGGACCAGAGAATTCGAATA CACGTGCTAANNNACGTATGCCA | 6776 | TGCAGGACCAGAGAATTCGAATA CAGCTGATACNNNACGTATGCCA | 7016 |
| TGCAGGACCAGAGAATTCGAATA CATCGTACTCNNNACGTATGCCA | 6537 | TGCAGGACCAGAGAATTCGAATA CAAAACAGTANNNACGTATGCCA | 6777 | TGCAGGACCAGAGAATTCGAATA CACTTTGATTNNNACGTATGCCA | 7017 |
| TGCAGGACCAGAGAATTCGAATA CATTCAGACGNNNACGTATGCCA | 6538 | TGCAGGACCAGAGAATTCGAATA CAGCATCATGNNNACGTATGCCA | 6778 | TGCAGGACCAGAGAATTCGAATA CACTTGTGAGNNNACGTATGCCA | 7018 |
| TGCAGGACCAGAGAATTCGAATA CAGCGCACGTNNNACGTATGCCA | 6539 | TGCAGGACCAGAGAATTCGAATA CAACCTGAANNNNACGTATGCCA | 6779 | TGCAGGACCAGAGAATTCGAATA CAACTTCCGTNNNACGTATGCCA | 7019 |
| TGCAGGACCAGAGAATTCGAATA CACCAGACATNNNACGTATGCCA | 6540 | TGCAGGACCAGAGAATTCGAATA CAACGCTACNNNATGCCA | 6780 | TGCAGGACCAGAGAATTCGAATA CACAACGTCNNNACGTATGCCA | 7020 |
| TGCAGGACCAGAGAATTCGAATA CATATTGATGNNNACGTATGCCA | 6541 | TGCAGGACCAGAGAATTCGAATA CACGTCAACANNNACGTATGCCA | 6781 | TGCAGGACCAGAGAATTCGAATA CAGTGCCTCNNNACGTATGCCA | 7021 |
| TGCAGGACCAGAGAATTCGAATA CACGAGATAGNNNACGTATGCCA | 6542 | TGCAGGACCAGAGAATTCGAATA CACCGGCCCNNNACGTATGCCA | 6782 | TGCAGGACCAGAGAATTCGAATA CAGTGGTGAANNNACGTATGCCA | 7022 |
| TGCAGGACCAGAGAATTCGAATA CAATACGAAANNNACGTATGCCA | 6543 | TGCAGGACCAGAGAATTCGAATA CATCCGTGCNNNACGTATGCCA | 6783 | TGCAGGACCAGAGAATTCGAATA CAAGTAAGTANNNACGTATGCCA | 7023 |
| TGCAGGACCAGAGAATTCGAATA CAGATGAGACNNNACGTATGCCA | 6544 | TGCAGGACCAGAGAATTCGAATA CAAAGACTGGNNNACGTATGCCA | 6784 | TGCAGGACCAGAGAATTCGAATA CAATTTATTNNNACGTATGCCA | 7024 |
| TGCAGGACCAGAGAATTCGAATA CATACAATCANNNACGTATGCCA | 6545 | TGCAGGACCAGAGAATTCGAATA CAGCAATGAGNNNACGTATGCCA | 6785 | TGCAGGACCAGAGAATTCGAATA CAGGAATGCANNNACGTATGCCA | 7025 |
| TGCAGGACCAGAGAATTCGAATA CATTTAATAANNNACGTATGCCA | 6546 | TGCAGGACCAGAGAATTCGAATA CAAGGAGCTANNNACGTATGCCA | 6786 | TGCAGGACCAGAGAATTCGAATA CACGTGCTTTNNNACGTATGCCA | 7026 |
| TGCAGGACCAGAGAATTCGAATA CAGCGCGTCANNNACGTATGCCA | 6547 | TGCAGGACCAGAGAATTCGAATA CACCTGAGATNNNACGTATGCCA | 6787 | TGCAGGACCAGAGAATTCGAATA CAGTTAAACTNNNACGTATGCCA | 7027 |
| TGCAGGACCAGAGAATTCGAATA CACGATGATCNNNACGTATGCCA | 6548 | TGCAGGACCAGAGAATTCGAATA CAACGGAGGCNNNACGTATGCCA | 6788 | TGCAGGACCAGAGAATTCGAATA CAATCTTAAGNNNACGTATGCCA | 7028 |
| TGCAGGACCAGAGAATTCGAATA CACCGAAGCCNNNCTAGCGTTAC | 6549 | TGCAGGACCAGAGAATTCGAATA CAGATCGGCNNNCTAGCGTTAC | 6789 | TGCAGGACCAGAGAATTCGAATA CAAACTCAGCNNNCTAGCGTTAC | 7029 |
| TGCAGGACCAGAGAATTCGAATA CACCAAAACANNNCTAGCGTTAC | 6550 | TGCAGGACCAGAGAATTCGAATA CATGCTGCANNNNCTAGCGTTAC | 6790 | TGCAGGACCAGAGAATTCGAATA CAACCAAAGCNNNCTAGCGTTAC | 7030 |
| TGCAGGACCAGAGAATTCGAATA CAGGTCTTCTNNNCTAGCGTTAC | 6551 | TGCAGGACCAGAGAATTCGAATA CATCGGAATCNNNCTAGCGTTAC | 6791 | TGCAGGACCAGAGAATTCGAATA CAGCGTAATCNNNCTAGCGTTAC | 7031 |
| TGCAGGACCAGAGAATTCGAATA CACCTCGGTCNNNCTAGCGTTAC | 6552 | TGCAGGACCAGAGAATTCGAATA CAGACGGCTCNNNCTAGCGTTAC | 6792 | TGCAGGACCAGAGAATTCGAATA CAAGGTGGTANNNCTAGCGTTAC | 7032 |
| TGCAGGACCAGAGAATTCGAATA CACCGGCTCANNNCTAGCGTTAC | 6553 | TGCAGGACCAGAGAATTCGAATA CAAGTTGGANNNNCTAGCGTTAC | 6793 | TGCAGGACCAGAGAATTCGAATA CACTTGAGTGNNNCTAGCGTTAC | 7033 |
| TGCAGGACCAGAGAATTCGAATA CAACCACCTTNNNCTAGCGTTAC | 6554 | TGCAGGACCAGAGAATTCGAATA CAAGTACGTCNNNCTAGCGTTAC | 6794 | TGCAGGACCAGAGAATTCGAATA CACTGCCGTNNNNCTAGCGTTAC | 7034 |

FIG. 21C

| Pool-28 | SEQ ID NO: | Pool-29 | SEQ ID NO: | Pool-30 | SEQ ID NO: |
|---|---|---|---|---|---|
| TGCAGGACCAGAGAATTCGAATA CATCTAAGTANNNCTAGCGTTAC | 6555 | TGCAGGACCAGAGAATTCGAATA CACGATTAATNNNCTAGCGTTAC | 6795 | TGCAGGACCAGAGAATTCGAATA CAGGGCTAATNNNCTAGCGTTAC | 7035 |
| TGCAGGACCAGAGAATTCGAATA CAATTATAATNNNCTAGCGTTAC | 6556 | TGCAGGACCAGAGAATTCGAATA CATTACGCCTNNNCTAGCGTTAC | 6796 | TGCAGGACCAGAGAATTCGAATA CAACCCCTGNNNCTAGCGTTAC | 7036 |
| TGCAGGACCAGAGAATTCGAATA CATGGACCGCNNNCTAGCGTTAC | 6557 | TGCAGGACCAGAGAATTCGAATA CAAGGAGTTGNNNCTAGCGTTAC | 6797 | TGCAGGACCAGAGAATTCGAATA CACCCTATCANNNCTAGCGTTAC | 7037 |
| TGCAGGACCAGAGAATTCGAATA CACTTCATTANNNCTAGCGTTAC | 6558 | TGCAGGACCAGAGAATTCGAATA CAGTACACCANNNCTAGCGTTAC | 6798 | TGCAGGACCAGAGAATTCGAATA CATAGAACAANNNCTAGCGTTAC | 7038 |
| TGCAGGACCAGAGAATTCGAATA CAACGCACTANNNCTAGCGTTAC | 6559 | TGCAGGACCAGAGAATTCGAATA CAGGAAAATTNNNCTAGCGTTAC | 6799 | TGCAGGACCAGAGAATTCGAATA CACCGGAGGANNNCTAGCGTTAC | 7039 |
| TGCAGGACCAGAGAATTCGAATA CATCATGGCANNNCTAGCGTTAC | 6560 | TGCAGGACCAGAGAATTCGAATA CACGGTTCTTNNNCTAGCGTTAC | 6800 | TGCAGGACCAGAGAATTCGAATA CAATGAACAANNNCTAGCGTTAC | 7040 |
| TGCAGGACCAGAGAATTCGAATA CAGGCTTAACNNNCTAGCGTTAC | 6561 | TGCAGGACCAGAGAATTCGAATA CAGGTCGACCNNNCTAGCGTTAC | 6801 | TGCAGGACCAGAGAATTCGAATA CATTCGAAGCNNNCTAGCGTTAC | 7041 |
| TGCAGGACCAGAGAATTCGAATA CAATGGTATTNNNCTAGCGTTAC | 6562 | TGCAGGACCAGAGAATTCGAATA CATTCGCTCANNNCTAGCGTTAC | 6802 | TGCAGGACCAGAGAATTCGAATA CAAACAACAANNNCTAGCGTTAC | 7042 |
| TGCAGGACCAGAGAATTCGAATA CAGTATGCTGNNNCTAGCGTTAC | 6563 | TGCAGGACCAGAGAATTCGAATA CACGCAGCGTNNNCTAGCGTTAC | 6803 | TGCAGGACCAGAGAATTCGAATA CATCCTTTGGNNNCTAGCGTTAC | 7043 |
| TGCAGGACCAGAGAATTCGAATA CAATCGTGGTNNNCTAGCGTTAC | 6564 | TGCAGGACCAGAGAATTCGAATA CAGCTGTGCGNNNCTAGCGTTAC | 6804 | TGCAGGACCAGAGAATTCGAATA CAAAACGAATNNNCTAGCGTTAC | 7044 |
| TGCAGGACCAGAGAATTCGAATA CAGCTTAGGTNNNCTAGCGTTAC | 6565 | TGCAGGACCAGAGAATTCGAATA CACACCAGTANNNCTAGCGTTAC | 6805 | TGCAGGACCAGAGAATTCGAATA CATCCAGTGANNNCTAGCGTTAC | 7045 |
| TGCAGGACCAGAGAATTCGAATA CATCTGTATTNNNCTAGCGTTAC | 6566 | TGCAGGACCAGAGAATTCGAATA CAATCATTGANNNCTAGCGTTAC | 6806 | TGCAGGACCAGAGAATTCGAATA CACTTCAAAANNNCTAGCGTTAC | 7046 |
| TGCAGGACCAGAGAATTCGAATA CAGGATAGCANNNCTAGCGTTAC | 6567 | TGCAGGACCAGAGAATTCGAATA CATAATCATGNNNCTAGCGTTAC | 6807 | TGCAGGACCAGAGAATTCGAATA CATATCTAGANNNCTAGCGTTAC | 7047 |
| TGCAGGACCAGAGAATTCGAATA CATTCACTCGNNNCTAGCGTTAC | 6568 | TGCAGGACCAGAGAATTCGAATA CAGTTGACCANNNCTAGCGTTAC | 6808 | TGCAGGACCAGAGAATTCGAATA CAAACGGCTTNNNCTAGCGTTAC | 7048 |
| TGCAGGACCAGAGAATTCGAATA CATTCGGACANNNCTAGCGTTAC | 6569 | TGCAGGACCAGAGAATTCGAATA CAACTCATGGNNNCTAGCGTTAC | 6809 | TGCAGGACCAGAGAATTCGAATA CAACTTTTCANNNCTAGCGTTAC | 7049 |
| TGCAGGACCAGAGAATTCGAATA CACGGTCGGTNNNCTAGCGTTAC | 6570 | TGCAGGACCAGAGAATTCGAATA CACCCAGTTNNNNCTAGCGTTAC | 6810 | TGCAGGACCAGAGAATTCGAATA CAAGTGCTTGNNNCTAGCGTTAC | 7050 |
| TGCAGGACCAGAGAATTCGAATA CAAGATCGCTNNNCTAGCGTTAC | 6571 | TGCAGGACCAGAGAATTCGAATA CATCAAGGAGNNNCTAGCGTTAC | 6811 | TGCAGGACCAGAGAATTCGAATA CAATGGTCANNNNCTAGCGTTAC | 7051 |
| TGCAGGACCAGAGAATTCGAATA CAGCATTCGANNNCTAGCGTTAC | 6572 | TGCAGGACCAGAGAATTCGAATA CAAACGCTTGNNNCTAGCGTTAC | 6812 | TGCAGGACCAGAGAATTCGAATA CAGCCCCTANNNCTAGCGTTAC | 7052 |
| TGCAGGACCAGAGAATTCGAATA CACGCTGATANNNCTAGCGTTAC | 6573 | TGCAGGACCAGAGAATTCGAATA CACTTAATATNNNCTAGCGTTAC | 6813 | TGCAGGACCAGAGAATTCGAATA CAGTTGCTCTNNNCTAGCGTTAC | 7053 |
| TGCAGGACCAGAGAATTCGAATA CACGGTTAACNNNCTAGCGTTAC | 6574 | TGCAGGACCAGAGAATTCGAATA CAAGTGTCCANNNCTAGCGTTAC | 6814 | TGCAGGACCAGAGAATTCGAATA CAGCATATATNNNCTAGCGTTAC | 7054 |
| TGCAGGACCAGAGAATTCGAATA CAAATGTCATNNNCTAGCGTTAC | 6575 | TGCAGGACCAGAGAATTCGAATA CAAGCGACGNNNNCTAGCGTTAC | 6815 | TGCAGGACCAGAGAATTCGAATA CAGGTCTTGANNNCTAGCGTTAC | 7055 |
| TGCAGGACCAGAGAATTCGAATA CAGCAAGACANNNCTAGCGTTAC | 6576 | TGCAGGACCAGAGAATTCGAATA CACTCTCCCNNNNCTAGCGTTAC | 6816 | TGCAGGACCAGAGAATTCGAATA CAACTATTCNNNNCTAGCGTTAC | 7056 |
| TGCAGGACCAGAGAATTCGAATA CACCAGCCTCNNNCTAGCGTTAC | 6577 | TGCAGGACCAGAGAATTCGAATA CAACTCACCTNNNCTAGCGTTAC | 6817 | TGCAGGACCAGAGAATTCGAATA CACTTAAAACNNNCTAGCGTTAC | 7057 |
| TGCAGGACCAGAGAATTCGAATA CACTTGTTGGNNNCTAGCGTTAC | 6578 | TGCAGGACCAGAGAATTCGAATA CAAATTTCGANNNCTAGCGTTAC | 6818 | TGCAGGACCAGAGAATTCGAATA CATCGCAGCGNNNCTAGCGTTAC | 7058 |
| TGCAGGACCAGAGAATTCGAATA CATATCGGTNNNNCTAGCGTTAC | 6579 | TGCAGGACCAGAGAATTCGAATA CAGTAATATNNNNCTAGCGTTAC | 6819 | TGCAGGACCAGAGAATTCGAATA CAGATTCGACNNNCTAGCGTTAC | 7059 |
| TGCAGGACCAGAGAATTCGAATA CACTGGCATANNNCTAGCGTTAC | 6580 | TGCAGGACCAGAGAATTCGAATA CACAAGAAATNNNCTAGCGTTAC | 6820 | TGCAGGACCAGAGAATTCGAATA CATGGCCGTGNNNCTAGCGTTAC | 7060 |
| TGCAGGACCAGAGAATTCGAATA CATGCAGGCNNNNCTAGCGTTAC | 6581 | TGCAGGACCAGAGAATTCGAATA CAATTCCCCANNNCTAGCGTTAC | 6821 | TGCAGGACCAGAGAATTCGAATA CAAAGGCATGNNNCTAGCGTTAC | 7061 |
| TGCAGGACCAGAGAATTCGAATA CATTCCTCCTNNNCTAGCGTTAC | 6582 | TGCAGGACCAGAGAATTCGAATA CACTCTTAGCNNNCTAGCGTTAC | 6822 | TGCAGGACCAGAGAATTCGAATA CAATGATCTANNNCTAGCGTTAC | 7062 |
| TGCAGGACCAGAGAATTCGAATA CATAACGGAGNNNCTAGCGTTAC | 6583 | TGCAGGACCAGAGAATTCGAATA CATACCAGCANNNCTAGCGTTAC | 6823 | TGCAGGACCAGAGAATTCGAATA CATCGGCAATNNNCTAGCGTTAC | 7063 |
| TGCAGGACCAGAGAATTCGAATA CAGAGTGGATNNNCTAGCGTTAC | 6584 | TGCAGGACCAGAGAATTCGAATA CACACGCTNNNNCTAGCGTTAC | 6824 | TGCAGGACCAGAGAATTCGAATA CAATCCGCTTNNNCTAGCGTTAC | 7064 |
| TGCAGGACCAGAGAATTCGAATA CATCGTAAATNNNCTAGCGTTAC | 6585 | TGCAGGACCAGAGAATTCGAATA CAAATCGAGGNNNCTAGCGTTAC | 6825 | TGCAGGACCAGAGAATTCGAATA CAGAGTGGTNNNNCTAGCGTTAC | 7065 |
| TGCAGGACCAGAGAATTCGAATA CACACGACANNNNCTAGCGTTAC | 6586 | TGCAGGACCAGAGAATTCGAATA CACATACAATNNNCTAGCGTTAC | 6826 | TGCAGGACCAGAGAATTCGAATA CAGGAACAGTNNNCTAGCGTTAC | 7066 |
| TGCAGGACCAGAGAATTCGAATA CAGCACCCCTNNNCTAGCGTTAC | 6587 | TGCAGGACCAGAGAATTCGAATA CATTATGTTCNNNCTAGCGTTAC | 6827 | TGCAGGACCAGAGAATTCGAATA CACTAAACATNNNCTAGCGTTAC | 7067 |

FIG. 21D

| Pool-28 | SEQ ID NO: | Pool-29 | SEQ ID NO: | Pool-30 | SEQ ID NO: |
|---|---|---|---|---|---|
| TGCAGGACCAGAGAATTCGAATA CAGATAATTCNNNCTAGCGTTAC | 6588 | TGCAGGACCAGAGAATTCGAATA CAGTCTGTCTNNNCTAGCGTTAC | 6828 | TGCAGGACCAGAGAATTCGAATA CAAAGGAGTCNNNCTAGCGTTAC | 7068 |
| TGCAGGACCAGAGAATTCGAATA CAAACTCAATNNNCTAGCGTTAC | 6589 | TGCAGGACCAGAGAATTCGAATA CAGTCTGAACNNNCTAGCGTTAC | 6829 | TGCAGGACCAGAGAATTCGAATA CATCCATGTCNNNCTAGCGTTAC | 7069 |
| TGCAGGACCAGAGAATTCGAATA CATCAAACTNNNCTAGCGTTAC | 6590 | TGCAGGACCAGAGAATTCGAATA CAAGGTGCGNNNCTAGCGTTAC | 6830 | TGCAGGACCAGAGAATTCGAATA CAGTACGAGANNNCTAGCGTTAC | 7070 |
| TGCAGGACCAGAGAATTCGAATA CAATTATTCCNNNCTAGCGTTAC | 6591 | TGCAGGACCAGAGAATTCGAATA CACAGAAACGNNNCTAGCGTTAC | 6831 | TGCAGGACCAGAGAATTCGAATA CAGGCCAGCTNNNCTAGCGTTAC | 7071 |
| TGCAGGACCAGAGAATTCGAATA CACTTCTTGGNNNCTAGCGTTAC | 6592 | TGCAGGACCAGAGAATTCGAATA CATCTGTTGCNNNCTAGCGTTAC | 6832 | TGCAGGACCAGAGAATTCGAATA CAGTCCGATANNNCTAGCGTTAC | 7072 |
| TGCAGGACCAGAGAATTCGAATA CATAAGTAAGNNNCTAGCGTTAC | 6593 | TGCAGGACCAGAGAATTCGAATA CACGATGGTTNNNCTAGCGTTAC | 6833 | TGCAGGACCAGAGAATTCGAATA CATGTTACAANNNCTAGCGTTAC | 7073 |
| TGCAGGACCAGAGAATTCGAATA CACTAACCCTNNNCTAGCGTTAC | 6594 | TGCAGGACCAGAGAATTCGAATA CAATAATATTNNNCTAGCGTTAC | 6834 | TGCAGGACCAGAGAATTCGAATA CACATTCCACNNNCTAGCGTTAC | 7074 |
| TGCAGGACCAGAGAATTCGAATA CAATAGCGTCNNNCTAGCGTTAC | 6595 | TGCAGGACCAGAGAATTCGAATA CAATCGACGTNNNCTAGCGTTAC | 6835 | TGCAGGACCAGAGAATTCGAATA CATGTTGAATNNNCTAGCGTTAC | 7075 |
| TGCAGGACCAGAGAATTCGAATA CAAAGTAATNNNCTAGCGTTAC | 6596 | TGCAGGACCAGAGAATTCGAATA CAGAGGAAAGNNNCTAGCGTTAC | 6836 | TGCAGGACCAGAGAATTCGAATA CAAGAAACGCNNNCTAGCGTTAC | 7076 |
| TGCAGGACCAGAGAATTCGAATA CATCACGTAGNNNCTAGCGTTAC | 6597 | TGCAGGACCAGAGAATTCGAATA CAATTACACANNNCTAGCGTTAC | 6837 | TGCAGGACCAGAGAATTCGAATA CATCCGACCCNNNCTAGCGTTAC | 7077 |
| TGCAGGACCAGAGAATTCGAATA CAAACCATATNNNCTAGCGTTAC | 6598 | TGCAGGACCAGAGAATTCGAATA CAGGACCTGNNNCTAGCGTTAC | 6838 | TGCAGGACCAGAGAATTCGAATA CACACTAGTGNNNCTAGCGTTAC | 7078 |
| TGCAGGACCAGAGAATTCGAATA CAGAGCAGTANNNCTAGCGTTAC | 6599 | TGCAGGACCAGAGAATTCGAATA CAACCTAGAGNNNCTAGCGTTAC | 6839 | TGCAGGACCAGAGAATTCGAATA CAACCGGCGTNNNCTAGCGTTAC | 7079 |
| TGCAGGACCAGAGAATTCGAATA CAATAAATTNNNCTAGCGTTAC | 6600 | TGCAGGACCAGAGAATTCGAATA CACACGGCGTNNNCTAGCGTTAC | 6840 | TGCAGGACCAGAGAATTCGAATA CACTTGCTACNNNCTAGCGTTAC | 7080 |
| TGCAGGACCAGAGAATTCGAATA CAGAGCTAAGNNNCTAGCGTTAC | 6601 | TGCAGGACCAGAGAATTCGAATA CAATTACGTANNNCTAGCGTTAC | 6841 | TGCAGGACCAGAGAATTCGAATA CATTGCAGTGNNNCTAGCGTTAC | 7081 |
| TGCAGGACCAGAGAATTCGAATA CAGCGGATCCNNNCTAGCGTTAC | 6602 | TGCAGGACCAGAGAATTCGAATA CATATGTTGANNNCTAGCGTTAC | 6842 | TGCAGGACCAGAGAATTCGAATA CAAATGAAGTNNNCTAGCGTTAC | 7082 |
| TGCAGGACCAGAGAATTCGAATA CATTCATAGANNNCTAGCGTTAC | 6603 | TGCAGGACCAGAGAATTCGAATA CACAGACTCANNNCTAGCGTTAC | 6843 | TGCAGGACCAGAGAATTCGAATA CACTCGCCCANNNCTAGCGTTAC | 7083 |
| TGCAGGACCAGAGAATTCGAATA CATTAAGCATNNNCTAGCGTTAC | 6604 | TGCAGGACCAGAGAATTCGAATA CACGGATGCCNNNCTAGCGTTAC | 6844 | TGCAGGACCAGAGAATTCGAATA CAGTGGACCCNNNCTAGCGTTAC | 7084 |
| TGCAGGACCAGAGAATTCGAATA CATCGAGCGCNNNCTAGCGTTAC | 6605 | TGCAGGACCAGAGAATTCGAATA CATACATCTTNNNCTAGCGTTAC | 6845 | TGCAGGACCAGAGAATTCGAATA CAACGACTCANNNCTAGCGTTAC | 7085 |
| TGCAGGACCAGAGAATTCGAATA CATCGCACCCNNNCTAGCGTTAC | 6606 | TGCAGGACCAGAGAATTCGAATA CACTTCGTGTNNNCTAGCGTTAC | 6846 | TGCAGGACCAGAGAATTCGAATA CAACAACTTANNNCTAGCGTTAC | 7086 |
| TGCAGGACCAGAGAATTCGAATA CACTTCGACANNNCTAGCGTTAC | 6607 | TGCAGGACCAGAGAATTCGAATA CAGAACGCGNNNCTAGCGTTAC | 6847 | TGCAGGACCAGAGAATTCGAATA CATCTGGTAGNNNCTAGCGTTAC | 7087 |
| TGCAGGACCAGAGAATTCGAATA CATTCCAGTCNNNCTAGCGTTAC | 6608 | TGCAGGACCAGAGAATTCGAATA CATCGGATTGNNNCTAGCGTTAC | 6848 | TGCAGGACCAGAGAATTCGAATA CACTATGGCANNNCTAGCGTTAC | 7088 |
| TGCAGGACCAGAGAATTCGAATA CAGTTTTACNNNGATCGACATG | 6609 | TGCAGGACCAGAGAATTCGAATA CAAGACAAATNNNGATCGACATG | 6849 | TGCAGGACCAGAGAATTCGAATA CAACCCGCGANNNGATCGACATG | 7089 |
| TGCAGGACCAGAGAATTCGAATA CAAACTTAGTNNNGATCGACATG | 6610 | TGCAGGACCAGAGAATTCGAATA CACGAAGTAGNNNGATCGACATG | 6850 | TGCAGGACCAGAGAATTCGAATA CACGCGGTACNNNGATCGACATG | 7090 |
| TGCAGGACCAGAGAATTCGAATA CACGCGCGCGNNNGATCGACATG | 6611 | TGCAGGACCAGAGAATTCGAATA CAAAGGAGCCNNNGATCGACATG | 6851 | TGCAGGACCAGAGAATTCGAATA CACACATCAGNNNGATCGACATG | 7091 |
| TGCAGGACCAGAGAATTCGAATA CAAACTGTTANNNGATCGACATG | 6612 | TGCAGGACCAGAGAATTCGAATA CATGAGTGGANNNGATCGACATG | 6852 | TGCAGGACCAGAGAATTCGAATA CATAGACACCNNNGATCGACATG | 7092 |
| TGCAGGACCAGAGAATTCGAATA CAGTAAGTTTNNNGATCGACATG | 6613 | TGCAGGACCAGAGAATTCGAATA CACGCTCCCANNNGATCGACATG | 6853 | TGCAGGACCAGAGAATTCGAATA CAATGTAAAGNNNGATCGACATG | 7093 |
| TGCAGGACCAGAGAATTCGAATA CACTTAGCAGNNNGATCGACATG | 6614 | TGCAGGACCAGAGAATTCGAATA CAACACTTCCNNNGATCGACATG | 6854 | TGCAGGACCAGAGAATTCGAATA CAATCCTCTGNNNGATCGACATG | 7094 |
| TGCAGGACCAGAGAATTCGAATA CAACTTTCCGNNNGATCGACATG | 6615 | TGCAGGACCAGAGAATTCGAATA CAGCAGTCATNNNGATCGACATG | 6855 | TGCAGGACCAGAGAATTCGAATA CAGTCGTCCCNNNGATCGACATG | 7095 |
| TGCAGGACCAGAGAATTCGAATA CACTCCTCTTNNNGATCGACATG | 6616 | TGCAGGACCAGAGAATTCGAATA CACCATATGNNNGATCGACATG | 6856 | TGCAGGACCAGAGAATTCGAATA CAACTTGCAGNNNGATCGACATG | 7096 |
| TGCAGGACCAGAGAATTCGAATA CAAGTAATGNNNGATCGACATG | 6617 | TGCAGGACCAGAGAATTCGAATA CAATGCGCGANNNGATCGACATG | 6857 | TGCAGGACCAGAGAATTCGAATA CAGAGCGCTCNNNGATCGACATG | 7097 |
| TGCAGGACCAGAGAATTCGAATA CACAGCCCNNNGATCGACATG | 6618 | TGCAGGACCAGAGAATTCGAATA CAGTTGAACCNNNGATCGACATG | 6858 | TGCAGGACCAGAGAATTCGAATA CATCGCAGGNNNGATCGACATG | 7098 |
| TGCAGGACCAGAGAATTCGAATA CACGTAATTANNNGATCGACATG | 6619 | TGCAGGACCAGAGAATTCGAATA CAAAGGTTGNNNGATCGACATG | 6859 | TGCAGGACCAGAGAATTCGAATA CACGATGCGNNNGATCGACATG | 7099 |
| TGCAGGACCAGAGAATTCGAATA CAGTTCGTTCNNNGATCGACATG | 6620 | TGCAGGACCAGAGAATTCGAATA CAGCACGCTGNNNGATCGACATG | 6860 | TGCAGGACCAGAGAATTCGAATA CAACCCCCACNNNGATCGACATG | 7100 |

FIG. 21E

| Pool-28 | SEQ ID NO: | Pool-29 | SEQ ID NO: | Pool-30 | SEQ ID NO: |
|---|---|---|---|---|---|
| TGCAGGACCAGAGAATTCGAATA CATTCCGTCANNNGATCGACATG | 6621 | TGCAGGACCAGAGAATTCGAATA CAGCTCATAGNNNGATCGACATG | 6861 | TGCAGGACCAGAGAATTCGAATA CATCATTTCANNNGATCGACATG | 7101 |
| TGCAGGACCAGAGAATTCGAATA CAACGACGTTNNNGATCGACATG | 6622 | TGCAGGACCAGAGAATTCGAATA CAACAGTCTGNNNGATCGACATG | 6862 | TGCAGGACCAGAGAATTCGAATA CATGCCGGTGNNNGATCGACATG | 7102 |
| TGCAGGACCAGAGAATTCGAATA CAAAGTAGCGNNNGATCGACATG | 6623 | TGCAGTACCAGAGAATTCGAATA CATTTAAGTGNNNGATCGACATG | 6863 | TGCAGGACCAGAGAATTCGAATA CACGCAAGAANNNGATCGACATG | 7103 |
| TGCAGGACCAGAGAATTCGAATA CAAGTGAAGCNNNGATCGACATG | 6624 | TGCAGGACCAGAGAATTCGAATA CAGATTAATCNNNGATCGACATG | 6864 | TGCAGGACCAGAGAATTCGAATA CATAGACCACNNNGATCGACATG | 7104 |
| TGCAGGACCAGAGAATTCGAATA CATTCTCATANNNGATCGACATG | 6625 | TGCAGGACCAGAGAATTCGAATA CAGAGAAAGGNNNGATCGACATG | 6865 | TGCAGGACCAGAGAATTCGAATA CAACCGAAGANNNGATCGACATG | 7105 |
| TGCAGGACCAGAGAATTCGAATA CAAGTAGAGCNNNGATCGACATG | 6626 | TGCAGGACCAGAGAATTCGAATA CAACATTCGGNNNGATCGACATG | 6866 | TGCAGGACCAGAGAATTCGAATA CATCTTGTTANNNGATCGACATG | 7106 |
| TGCAGGACCAGAGAATTCGAATA CATCCCGATTNNNGATCGACATG | 6627 | TGCAGGACCAGAGAATTCGAATA CATTGCGTCTNNNGATCGACATG | 6867 | TGCAGGACCAGAGAATTCGAATA CACAGACTGNNNGATCGACATG | 7107 |
| TGCAGGACCAGAGAATTCGAATA CACAAGGTCTNNNGATCGACATG | 6628 | TGCAGGACCAGAGAATTCGAATA CAGCTCACAANNNGATCGACATG | 6868 | TGCAGGACCAGAGAATTCGAATA CAGATCTGCANNNGATCGACATG | 7108 |
| TGCAGGACCAGAGAATTCGAATA CAGAGTATGNNNGATCGACATG | 6629 | TGCAGGACCAGAGAATTCGAATA CACGTTAACGNNNGATCGACATG | 6869 | TGCAGGACCAGAGAATTCGAATA CATCGAAGGANNNGATCGACATG | 7109 |
| TGCAGGACCAGAGAATTCGAATA CACCGCAGTGNNNGATCGACATG | 6630 | TGCAGGACCAGAGAATTCGAATA CAGTACGTTGNNNGATCGACATG | 6870 | TGCAGGACCAGAGAATTCGAATA CACGGAGCAGNNNGATCGACATG | 7110 |
| TGCAGGACCAGAGAATTCGAATA CAGAAGCTCTNNNGATCGACATG | 6631 | TGCAGGACCAGAGAATTCGAATA CATGCTCAGANNNGATCGACATG | 6871 | TGCAGGACCAGAGAATTCGAATA CACACCGGACNNNGATCGACATG | 7111 |
| TGCAGGACCAGAGAATTCGAATA CAGTGCAAGANNNGATCGACATG | 6632 | TGCAGGACCAGAGAATTCGAATA CATACCAAATNNNGATCGACATG | 6872 | TGCAGGACCAGAGAATTCGAATA CAATAACGTTNNNGATCGACATG | 7112 |
| TGCAGGACCAGAGAATTCGAATA CAAACGGTAGNNNGATCGACATG | 6633 | TGCAGGACCAGAGAATTCGAATA CACCATGATGNNNGATCGACATG | 6873 | TGCAGGACCAGAGAATTCGAATA CATGTCTGGANNNGATCGACATG | 7113 |
| TGCAGGACCAGAGAATTCGAATA CACTTCGACTNNNGATCGACATG | 6634 | TGCAGGACCAGAGAATTCGAATA CATATATGCANNNGATCGACATG | 6874 | TGCAGGACCAGAGAATTCGAATA CATATGGACCNNNGATCGACATG | 7114 |
| TGCAGGACCAGAGAATTCGAATA CACCGACGACNNNGATCGACATG | 6635 | TGCAGGACCAGAGAATTCGAATA CACCGCTTATNNNGATCGACATG | 6875 | TGCAGGACCAGAGAATTCGAATA CACAACTTGGNNNGATCGACATG | 7115 |
| TGCAGGACCAGAGAATTCGAATA CACTACACTCNNNGATCGACATG | 6636 | TGCAGGACCAGAGAATTCGAATA CAGGCGTCACNNNGATCGACATG | 6876 | TGCAGGACCAGAGAATTCGAATA CACAATCGACNNNGATCGACATG | 7116 |
| TGCAGGACCAGAGAATTCGAATA CAAGCTAAGGNNNGATCGACATG | 6637 | TGCAGGACCAGAGAATTCGAATA CAGGCATAAGNNNGATCGACATG | 6877 | TGCAGGACCAGAGAATTCGAATA CAGCAAGGCGNNNGATCGACATG | 7117 |
| TGCAGGACCAGAGAATTCGAATA CAGAGTATCCNNNGATCGACATG | 6638 | TGCAGGACCAGAGAATTCGAATA CAGAATTTGTNNNGATCGACATG | 6878 | TGCAGGACCAGAGAATTCGAATA CAGCCAACGCNNNGATCGACATG | 7118 |
| TGCAGGACCAGAGAATTCGAATA CATCCTACCANNNGATCGACATG | 6639 | TGCAGGACCAGAGAATTCGAATA CATCTTGACCNNNGATCGACATG | 6879 | TGCAGGACCAGAGAATTCGAATA CATCGTTAAANNNGATCGACATG | 7119 |
| TGCAGGACCAGAGAATTCGAATA CATTTTTCTCNNNGATCGACATG | 6640 | TGCAGGACCAGAGAATTCGAATA CAACACCTAGNNNGATCGACATG | 6880 | TGCAGGACCAGAGAATTCGAATA CACTAGCGTANNNGATCGACATG | 7120 |
| TGCAGGACCAGAGAATTCGAATA CACCGATAAGNNNGATCGACATG | 6641 | TGCAGGACCAGAGAATTCGAATA CAATCTCCAANNNGATCGACATG | 6881 | TGCAGGACCAGAGAATTCGAATA CACTGAGTTGNNNGATCGACATG | 7121 |
| TGCAGGACCAGAGAATTCGAATA CACAAATCGCNNNGATCGACATG | 6642 | TGCAGGACCAGAGAATTCGAATA CATTGAGATTNNNGATCGACATG | 6882 | TGCAGGACCAGAGAATTCGAATA CATGCGCGTNNNGATCGACATG | 7122 |
| TGCAGGACCAGAGAATTCGAATA CAGTGTCGGCNNNGATCGACATG | 6643 | TGCAGGACCAGAGAATTCGAATA CATCAACCAGNNNGATCGACATG | 6883 | TGCAGGACCAGAGAATTCGAATA CAGTGACTTGNNNGATCGACATG | 7123 |
| TGCAGGACCAGAGAATTCGAATA CAAAGCTATTNNNGATCGACATG | 6644 | TGCAGGACCAGAGAATTCGAATA CATTTGACGGNNNGATCGACATG | 6884 | TGCAGGACCAGAGAATTCGAATA CACTGCGAATNNNGATCGACATG | 7124 |
| TGCAGGACCAGAGAATTCGAATA CAACCGGACCNNNGATCGACATG | 6645 | TGCAGGACCAGAGAATTCGAATA CAGTTCATTNNNGATCGACATG | 6885 | TGCAGGACCAGAGAATTCGAATA CACATGACACNNNGATCGACATG | 7125 |
| TGCAGGACCAGAGAATTCGAATA CATTAAATGCNNNGATCGACATG | 6646 | TGCAGGACCAGAGAATTCGAATA CAGAGTGGTANNNGATCGACATG | 6886 | TGCAGGACCAGAGAATTCGAATA CAGCGATTTGNNNGATCGACATG | 7126 |
| TGCAGGACCAGAGAATTCGAATA CACTGCAAGTNNNGATCGACATG | 6647 | TGCAGGACCAGAGAATTCGAATA CAAGTTGCTGNNNGATCGACATG | 6887 | TGCAGGACCAGAGAATTCGAATA CAACTAGGAGNNNGATCGACATG | 7127 |
| TGCAGGACCAGAGAATTCGAATA CACCCTTAACNNNGATCGACATG | 6648 | TGCAGGACCAGAGAATTCGAATA CAGATTTACANNNGATCGACATG | 6888 | TGCAGGACCAGAGAATTCGAATA CAGCGCAACANNNGATCGACATG | 7128 |
| TGCAGGACCAGAGAATTCGAATA CAAGTGAGACNNNGATCGACATG | 6649 | TGCAGGACCAGAGAATTCGAATA CACTAACAATNNNGATCGACATG | 6889 | TGCAGGACCAGAGAATTCGAATA CACACAGCCGNNNGATCGACATG | 7129 |
| TGCAGGACCAGAGAATTCGAATA CATATTAGACNNNGATCGACATG | 6650 | TGCAGGACCAGAGAATTCGAATA CAAGCTATCTNNNGATCGACATG | 6890 | TGCAGGACCAGAGAATTCGAATA CAGCCGTTGTNNNGATCGACATG | 7130 |
| TGCAGGACCAGAGAATTCGAATA CAGTTGGCTANNNGATCGACATG | 6651 | TGCAGGACCAGAGAATTCGAATA CACGACCGGCTNNNGATCGACATG | 6891 | TGCAGGACCAGAGAATTCGAATA CAAATATCGTNNNGATCGACATG | 7131 |
| TGCAGGACCAGAGAATTCGAATA CATCGCTAAGNNNGATCGACATG | 6652 | TGCAGGACCAGAGAATTCGAATA CACCGCGTACNNNGATCGACATG | 6892 | TGCAGGACCAGAGAATTCGAATA CACCGAAAGANNNGATCGACATG | 7132 |
| TGCAGGACCAGAGAATTCGAATA CAAGCCCCTCNNNGATCGACATG | 6653 | TGCAGGACCAGAGAATTCGAATA CATTGCAGGTNNNGATCGACATG | 6893 | TGCAGGACCAGAGAATTCGAATA CACAAGGTGNNNGATCGACATG | 7133 |

FIG. 21F

| Pool-28 | SEQ ID NO: | Pool-29 | SEQ ID NO: | Pool-30 | SEQ ID NO: |
|---|---|---|---|---|---|
| TGCAGGACCAGAGAATTCGAATA CATTACGAATNNNGATCGACATG | 6654 | TGCAGGACCAGAGAATTCGAATA CATGAGCTGTNNNGATCGACATG | 6894 | TGCAGGACCAGAGAATTCGAATA CAAAATCCATNNNGATCGACATG | 7134 |
| TGCAGGACCAGAGAATTCGAATA CAGGCCACCANNNGATCGACATG | 6655 | TGCAGGACCAGAGAATTCGAATA CAAGTCTCAGNNNGATCGACATG | 6895 | TGCAGGACCAGAGAATTCGAATA CAAACAATCNNNGATCGACATG | 7135 |
| TGCAGGACCAGAGAATTCGAATA CATCCTTATANNNGATCGACATG | 6656 | TGCAGGACCAGAGAATTCGAATA CAATTCCTCTNNNGATCGACATG | 6896 | TGCAGGACCAGAGAATTCGAATA CACATTGGCANNNGATCGACATG | 7136 |
| TGCAGGACCAGAGAATTCGAATA CATCAGTCTCNNNGATCGACATG | 6657 | TGCAGGACCAGAGAATTCGAATA CAGAGAGAGANNNGATCGACATG | 6897 | TGCAGGACCAGAGAATTCGAATA CACTACAACGNNNGATCGACATG | 7137 |
| TGCAGGACCAGAGAATTCGAATA CACGACTTCTNNNGATCGACATG | 6658 | TGCAGGACCAGAGAATTCGAATA CAGCAGAGCGNNNGATCGACATG | 6898 | TGCAGGACCAGAGAATTCGAATA CAATCGAGAGNNNGATCGACATG | 7138 |
| TGCAGGACCAGAGAATTCGAATA CAAGGTAACGNNNGATCGACATG | 6659 | TGCAGGACCAGAGAATTCGAATA CAGGCACTATNNNGATCGACATG | 6899 | TGCAGGACCAGAGAATTCGAATA CACGCGTCCTNNNGATCGACATG | 7139 |
| TGCAGGACCAGAGAATTCGAATA CAAGACACTCNNNGATCGACATG | 6660 | TGCAGGACCAGAGAATTCGAATA CAGACCCTCAANNNGATCGACATG | 6900 | TGCAGGACCAGAGAATTCGAATA CATTACGTTTNNNGATCGACATG | 7140 |
| TGCAGGACCAGAGAATTCGAATA CAGGCTTCGGNNNGATCGACATG | 6661 | TGCAGGACCAGAGAATTCGAATA CAAATAACTCNNNGATCGACATG | 6901 | TGCAGGACCAGAGAATTCGAATA CAGTAGTCGTNNNGATCGACATG | 7141 |
| TGCAGGACCAGAGAATTCGAATA CACAATTCGGNNNGATCGACATG | 6662 | TGCAGGACCAGAGAATTCGAATA CATCATATTCNNNGATCGACATG | 6902 | TGCAGGACCAGAGAATTCGAATA CATGCCTCGCNNNGATCGACATG | 7142 |
| TGCAGGACCAGAGAATTCGAATA CAGGCTCTGGNNNGATCGACATG | 6663 | TGCAGGACCAGAGAATTCGAATA CAGATAGAATNNNGATCGACATG | 6903 | TGCAGGACCAGAGAATTCGAATA CAATACATTGNNNGATCGACATG | 7143 |
| TGCAGGACCAGAGAATTCGAATA CATCTCTGACNNNGATCGACATG | 6664 | TGCAGGACCAGAGAATTCGAATA CACCTGGACGNNNGATCGACATG | 6904 | TGCAGGACCAGAGAATTCGAATA CATATAAAABNNNGATCGACATG | 7144 |
| TGCAGGACCAGAGAATTCGAATA CAGAGTAGGTNNNGATCGACATG | 6665 | TGCAGGACCAGAGAATTCGAATA CATAACAGNNNGATCGACATG | 6905 | TGCAGGACCAGAGAATTCGAATA CATACCTGCTNNNGATCGACATG | 7145 |
| TGCAGGACCAGAGAATTCGAATA CAATTTTTTANNNGATCGACATG | 6666 | TGCAGGACCAGAGAATTCGAATA CAGCAGCCGTNNNGATCGACATG | 6906 | TGCAGGACCAGAGAATTCGAATA CATGAGAACGNNNGATCGACATG | 7146 |
| TGCAGGACCAGAGAATTCGAATA CAATTTCTACNNNGATCGACATG | 6667 | TGCAGGACCAGAGAATTCGAATA CACAGACCGNNNGATCGACATG | 6907 | TGCAGGACCAGAGAATTCGAATA CAGGAACTCANNNGATCGACATG | 7147 |
| TGCAGGACCAGAGAATTCGAATA CAAACGCTGTNNNGATCGACATG | 6668 | TGCAGGACCAGAGAATTCGAATA CATTAAGAAGNNNGATCGACATG | 6908 | TGCAGGACCAGAGAATTCGAATA CAAGAGCGCGNNNGATCGACATG | 7148 |
| TGCAGGACCAGAGAATTCGAATA CAATCGACTGNNNTGCATCAGGT | 6669 | TGCAGGACCAGAGAATTCGAATA CATTCATAAGNNNTGCATCAGGT | 6909 | TGCAGGACCAGAGAATTCGAATA CAACGCCACGNNNTGCATCAGGT | 7149 |
| TGCAGGACCAGAGAATTCGAATA CATAACGATTNNNTGCATCAGGT | 6670 | TGCAGGACCAGAGAATTCGAATA CACCACAGGCNNNTGCATCAGGT | 6910 | TGCAGGACCAGAGAATTCGAATA CATCCCTAANNNNTGCATCAGGT | 7150 |
| TGCAGGACCAGAGAATTCGAATA CAGCCCAGCANNNTGCATCAGGT | 6671 | TGCAGGACCAGAGAATTCGAATA CAGTCAGGCNNNTGCATCAGGT | 6911 | TGCAGGACCAGAGAATTCGAATA CATCGGCATANNNTGCATCAGGT | 7151 |
| TGCAGGACCAGAGAATTCGAATA CAACAAACGGNNNTGCATCAGGT | 6672 | TGCAGGACCAGAGAATTCGAATA CAGTCGGCACNNNTGCATCAGGT | 6912 | TGCAGGACCAGAGAATTCGAATA CACGCCTCCANNNTGCATCAGGT | 7152 |
| TGCAGGACCAGAGAATTCGAATA CAAGAGTGCANNNTGCATCAGGT | 6673 | TGCAGGACCAGAGAATTCGAATA CATAGTCTGGNNNTGCATCAGGT | 6913 | TGCAGGACCAGAGAATTCGAATA CAAGGTGGCNNNTGCATCAGGT | 7153 |
| TGCAGGACCAGAGAATTCGAATA CACGGATCGCNNNTGCATCAGGT | 6674 | TGCAGGACCAGAGAATTCGAATA CACATTATTCNNNTGCATCAGGT | 6914 | TGCAGGACCAGAGAATTCGAATA CAAAGGTTCNNNTGCATCAGGT | 7154 |
| TGCAGGACCAGAGAATTCGAATA CAGGAATCCTNNNTGCATCAGGT | 6675 | TGCAGGACCAGAGAATTCGAATA CAGAAGACCANNNTGCATCAGGT | 6915 | TGCAGGACCAGAGAATTCGAATA CACGGAAGGCNNNTGCATCAGGT | 7155 |
| TGCAGGACCAGAGAATTCGAATA CAACCTAAATNNNTGCATCAGGT | 6676 | TGCAGGACCAGAGAATTCGAATA CAAATTCTCTNNNTGCATCAGGT | 6916 | TGCAGGACCAGAGAATTCGAATA CAAGGCATTCNNNTGCATCAGGT | 7156 |
| TGCAGGACCAGAGAATTCGAATA CACGTATCGANNNTGCATCAGGT | 6677 | TGCAGGACCAGAGAATTCGAATA CAGCCATCGGNNNTGCATCAGGT | 6917 | TGCAGGACCAGAGAATTCGAATA CACACCAGCGNNNTGCATCAGGT | 7157 |
| TGCAGGACCAGAGAATTCGAATA CATCAGATATNNNTGCATCAGGT | 6678 | TGCAGGACCAGAGAATTCGAATA CATATAATTANNNTGCATCAGGT | 6918 | TGCAGGACCAGAGAATTCGAATA CATATGCGTGNNNTGCATCAGGT | 7158 |
| TGCAGGACCAGAGAATTCGAATA CAGCGACCGTNNNTGCATCAGGT | 6679 | TGCAGGACCAGAGAATTCGAATA CAACGAACAGNNNTGCATCAGGT | 6919 | TGCAGGACCAGAGAATTCGAATA CAGCATAGCTNNNTGCATCAGGT | 7159 |
| TGCAGGACCAGAGAATTCGAATA CATCAGACTGNNNTGCATCAGGT | 6680 | TGCAGGACCAGAGAATTCGAATA CAAGGCCCGTNNNTGCATCAGGT | 6920 | TGCAGGACCAGAGAATTCGAATA CATCACTAGGNNNTGCATCAGGT | 7160 |
| TGCAGGACCAGAGAATTCGAATA CAATGCACGTNNNTGCATCAGGT | 6681 | TGCAGGACCAGAGAATTCGAATA CACAAAGAGCNNNTGCATCAGGT | 6921 | TGCAGGACCAGAGAATTCGAATA CAGCCGAGCTNNNTGCATCAGGT | 7161 |
| TGCAGGACCAGAGAATTCGAATA CATCTACTGCNNNTGCATCAGGT | 6682 | TGCAGGACCAGAGAATTCGAATA CATTCAGGACNNNTGCATCAGGT | 6922 | TGCAGGACCAGAGAATTCGAATA CAACTGCCAANNNTGCATCAGGT | 7162 |
| TGCAGGACCAGAGAATTCGAATA CACTCGTTGTNNNTGCATCAGGT | 6683 | TGCAGGACCAGAGAATTCGAATA CAAGCACGCNNNTGCATCAGGT | 6923 | TGCAGGACCAGAGAATTCGAATA CACCGACAATNNNTGCATCAGGT | 7163 |
| TGCAGGACCAGAGAATTCGAATA CACTGTGTAGNNNTGCATCAGGT | 6684 | TGCAGGACCAGAGAATTCGAATA CAGACACATCNNNTGCATCAGGT | 6924 | TGCAGGACCAGAGAATTCGAATA CACAGGCCCANNNTGCATCAGGT | 7164 |
| TGCAGGACCAGAGAATTCGAATA CAGCTTGCTNNNTGCATCAGGT | 6685 | TGCAGGACCAGAGAATTCGAATA CACGATACANNNTGCATCAGGT | 6925 | TGCAGGACCAGAGAATTCGAATA CACABCCCCNNNTGCATCAGGT | 7165 |
| TGCAGGACCAGAGAATTCGAATA CACTTTTCTTNNNTGCATCAGGT | 6686 | TGCAGGACCAGAGAATTCGAATA CAATACGCGTNNNTGCATCAGGT | 6926 | TGCAGGACCAGAGAATTCGAATA CAAAGACGACNNNTGCATCAGGT | 7166 |

FIG. 21G

| Pool-28 | SEQ ID NO: | Pool-29 | SEQ ID NO: | Pool-30 | SEQ ID NO: |
|---|---|---|---|---|---|
| TGCAGGACCAGAGAATTCGAATA CATCAACTCCNNNTGCATCAGGT | 6687 | TGCAGGACCAGAGAATTCGAATA CATACACGCANNNTGCATCAGGT | 6927 | TGCAGGACCAGAGAATTCGAATA CATACAAGAANNNTGCATCAGGT | 7167 |
| TGCAGGACCAGAGAATTCGAATA CAATCCAGCANNNTGCATCAGGT | 6688 | TGCAGGACCAGAGAATTCGAATA CACTCTCTCTNNNTGCATCAGGT | 6928 | TGCAGGACCAGAGAATTCGAATA CAATAGGCCTNNNTGCATCAGGT | 7168 |
| TGCAGGACCAGAGAATTCGAATA CAAACCGCTANNNTGCATCAGGT | 6689 | TGCAGGACCAGAGAATTCGAATA CACAATGAGGNNNTGCATCAGGT | 6929 | TGCAGGACCAGAGAATTCGAATA CATTGGATATNNNTGCATCAGGT | 7169 |
| TGCAGGACCAGAGAATTCGAATA CACGCCTGTCNNNTGCATCAGGT | 6690 | TGCAGGACCAGAGAATTCGAATA CACACAGTGTNNNTGCATCAGGT | 6930 | TGCAGGACCAGAGAATTCGAATA CACTATCGCTNNNTGCATCAGGT | 7170 |
| TGCAGGACCAGAGAATTCGAATA CATAAGGCCTNNNTGCATCAGGT | 6691 | TGCAGGACCAGAGAATTCGAATA CAAACATACTNNNTGCATCAGGT | 6931 | TGCAGGACCAGAGAATTCGAATA CACTCTTGACNNNTGCATCAGGT | 7171 |
| TGCAGGACCAGAGAATTCGAATA CATGTCATGGNNNTGCATCAGGT | 6692 | TGCAGGACCAGAGAATTCGAATA CACGGCATCGNNNTGCATCAGGT | 6932 | TGCAGGACCAGAGAATTCGAATA CAAATTAGGANNNTGCATCAGGT | 7172 |
| TGCAGGACCAGAGAATTCGAATA CATAGCAGTCNNNTGCATCAGGT | 6693 | TGCAGGACCAGAGAATTCGAATA CAAGTAGATANNNTGCATCAGGT | 6933 | TGCAGGACCAGAGAATTCGAATA CACGTTGCTTNNNTGCATCAGGT | 7173 |
| TGCAGGACCAGAGAATTCGAATA CAGCGCTGACNNNTGCATCAGGT | 6694 | TGCAGGACCAGAGAATTCGAATA CAGCGATCCGNNNTGCATCAGGT | 6934 | TGCAGGACCAGAGAATTCGAATA CATTTCCCCTNNNTGCATCAGGT | 7174 |
| TGCAGGACCAGAGAATTCGAATA CATATATCCTNNNTGCATCAGGT | 6695 | TGCAGGACCAGAGAATTCGAATA CAATTAAATTNNNTGCATCAGGT | 6935 | TGCAGGACCAGAGAATTCGAATA CAACTACCTCNNNTGCATCAGGT | 7175 |
| TGCAGGACCAGAGAATTCGAATA CACACGAAAGNNNTGCATCAGGT | 6696 | TGCAGGACCAGAGAATTCGAATA CAAGATTCATNNNTGCATCAGGT | 6936 | TGCAGGACCAGAGAATTCGAATA CAACTCTGCTNNNTGCATCAGGT | 7176 |
| TGCAGGACCAGAGAATTCGAATA CAATAAGTCTNNNTGCATCAGGT | 6697 | TGCAGGACCAGAGAATTCGAATA CATCACCTGTNNNTGCATCAGGT | 6937 | TGCAGGACCAGAGAATTCGAATA CACTACCTCANNNTGCATCAGGT | 7177 |
| TGCAGGACCAGAGAATTCGAATA CAGCTGTCCCNNNTGCATCAGGT | 6698 | TGCAGGACCAGAGAATTCGAATA CACAAATACTNNNTGCATCAGGT | 6938 | TGCAGGACCAGAGAATTCGAATA CAACTGCTAGNNNTGCATCAGGT | 7178 |
| TGCAGGACCAGAGAATTCGAATA CAATGACCTGNNNTGCATCAGGT | 6699 | TGCAGGACCAGAGAATTCGAATA CATTTAGCCANNNTGCATCAGGT | 6939 | TGCAGGACCAGAGAATTCGAATA CACGCGCAGTNNNTGCATCAGGT | 7179 |
| TGCAGGACCAGAGAATTCGAATA CAATACCCTNNNTGCATCAGGT | 6700 | TGCAGGACCAGAGAATTCGAATA CATCCTAGTCNNNTGCATCAGGT | 6940 | TGCAGGACCAGAGAATTCGAATA CAGGCTTTCTNNNTGCATCAGGT | 7180 |
| TGCAGGACCAGAGAATTCGAATA CATGAGGTAGNNNTGCATCAGGT | 6701 | TGCAGGACCAGAGAATTCGAATA CATAAAGAGTNNNTGCATCAGGT | 6941 | TGCAGGACCAGAGAATTCGAATA CACTGGACTANNNTGCATCAGGT | 7181 |
| TGCAGGACCAGAGAATTCGAATA CACGAATCTGNNNTGCATCAGGT | 6702 | TGCAGGACCAGAGAATTCGAATA CACATGCACANNNTGCATCAGGT | 6942 | TGCAGGACCAGAGAATTCGAATA CAACATCAGCNNNTGCATCAGGT | 7182 |
| TGCAGGACCAGAGAATTCGAATA CAGCCGACGTNNNTGCATCAGGT | 6703 | TGCAGGACCAGAGAATTCGAATA CATTTCAACTNNNTGCATCAGGT | 6943 | TGCAGGACCAGAGAATTCGAATA CATCAGTTCCNNNTGCATCAGGT | 7183 |
| TGCAGGACCAGAGAATTCGAATA CATTCAAACANNNTGCATCAGGT | 6704 | TGCAGGACCAGAGAATTCGAATA CACTGATGTGNNNTGCATCAGGT | 6944 | TGCAGGACCAGAGAATTCGAATA CATCACGATGNNNTGCATCAGGT | 7184 |
| TGCAGGACCAGAGAATTCGAATA CAAGGCTTACNNNTGCATCAGGT | 6705 | TGCAGGACCAGAGAATTCGAATA CACCCGTTCGNNNTGCATCAGGT | 6945 | TGCAGGACCAGAGAATTCGAATA CAGTATGCACNNNTGCATCAGGT | 7185 |
| TGCAGGACCAGAGAATTCGAATA CAAAAACGGCNNNTGCATCAGGT | 6706 | TGCAGGACCAGAGAATTCGAATA CACATAAGAANNNTGCATCAGGT | 6946 | TGCAGGACCAGAGAATTCGAATA CATCAGGCGCNNNTGCATCAGGT | 7186 |
| TGCAGGACCAGAGAATTCGAATA CAGATAGGACNNNTGCATCAGGT | 6707 | TGCAGGACCAGAGAATTCGAATA CAGATTACGCNNNTGCATCAGGT | 6947 | TGCAGGACCAGAGAATTCGAATA CAGTTTTCCCNNNTGCATCAGGT | 7187 |
| TGCAGGACCAGAGAATTCGAATA CAATGCCGAANNNTGCATCAGGT | 6708 | TGCAGGACCAGAGAATTCGAATA CACTGACGATNNNTGCATCAGGT | 6948 | TGCAGGACCAGAGAATTCGAATA CAGGTCGGAGNNNTGCATCAGGT | 7188 |
| TGCAGGACCAGAGAATTCGAATA CAACCAGAGNNNTGCATCAGGT | 6709 | TGCAGGACCAGAGAATTCGAATA CAACTTTCTANNNTGCATCAGGT | 6949 | TGCAGGACCAGAGAATTCGAATA CAATAGGCGNNNTGCATCAGGT | 7189 |
| TGCAGGACCAGAGAATTCGAATA CACAAACGCTNNNTGCATCAGGT | 6710 | TGCAGGACCAGAGAATTCGAATA CACACATAGCNNNTGCATCAGGT | 6950 | TGCAGGACCAGAGAATTCGAATA CAAGCCGACCNNNTGCATCAGGT | 7190 |
| TGCAGGACCAGAGAATTCGAATA CACGCTTTCANNNTGCATCAGGT | 6711 | TGCAGGACCAGAGAATTCGAATA CATTAGTCAANNNTGCATCAGGT | 6951 | TGCAGGACCAGAGAATTCGAATA CACATGTCAGNNNTGCATCAGGT | 7191 |
| TGCAGGACCAGAGAATTCGAATA CATCCAGGCGNNNTGCATCAGGT | 6712 | TGCAGGACCAGAGAATTCGAATA CATGGTCGCGNNNTGCATCAGGT | 6952 | TGCAGGACCAGAGAATTCGAATA CATTTTAGCTNNNTGCATCAGGT | 7192 |
| TGCAGGACCAGAGAATTCGAATA CATTGAAATCNNNTGCATCAGGT | 6713 | TGCAGGACCAGAGAATTCGAATA CATTCTGACCNNNTGCATCAGGT | 6953 | TGCAGGACCAGAGAATTCGAATA CATCGAGTTGNNNTGCATCAGGT | 7193 |
| TGCAGGACCAGAGAATTCGAATA CACCTGCTGCNNNTGCATCAGGT | 6714 | TGCAGGACCAGAGAATTCGAATA CATAAAACCTNNNTGCATCAGGT | 6954 | TGCAGGACCAGAGAATTCGAATA CAGCCACCTCNNNTGCATCAGGT | 7194 |
| TGCAGGACCAGAGAATTCGAATA CACGAATGAGNNNTGCATCAGGT | 6715 | TGCAGGACCAGAGAATTCGAATA CAACTATAACNNNTGCATCAGGT | 6955 | TGCAGGACCAGAGAATTCGAATA CATGTTGTGGNNNTGCATCAGGT | 7195 |
| TGCAGGACCAGAGAATTCGAATA CATGTGTTAANNNTGCATCAGGT | 6716 | TGCAGGACCAGAGAATTCGAATA CATATGATGTNNNTGCATCAGGT | 6956 | TGCAGGACCAGAGAATTCGAATA CAGTTGTGTGNNNTGCATCAGGT | 7196 |
| TGCAGGACCAGAGAATTCGAATA CATTCAAACNNNTGCATCAGGT | 6717 | TGCAGGACCAGAGAATTCGAATA CATCACCGCNNNTGCATCAGGT | 6957 | TGCAGGACCAGAGAATTCGAATA CACGTGAACTNNNTGCATCAGGT | 7197 |
| TGCAGGACCAGAGAATTCGAATA CACAGCCCAANNNTGCATCAGGT | 6718 | TGCAGGACCAGAGAATTCGAATA CAAGGTTATTNNNTGCATCAGGT | 6958 | TGCAGGACCAGAGAATTCGAATA CAAAGGCTCTNNNTGCATCAGGT | 7198 |
| TGCAGGACCAGAGAATTCGAATA CAGACAGTAGNNNTGCATCAGGT | 6719 | TGCAGGACCAGAGAATTCGAATA CAAGCAGCTTNNNTGCATCAGGT | 6959 | TGCAGGACCAGAGAATTCGAATA CATATTCTTGNNNTGCATCAGGT | 7199 |

FIG. 21H

| Pool-28 | SEQ ID NO: | Pool-29 | SEQ ID NO: | Pool-30 | SEQ ID NO: |
|---|---|---|---|---|---|
| TGCAGGACCAGAGAATTCGAATA CACATTTGTTNNNTGCATCAGGT | 6720 | TGCAGGACCAGAGAATTCGAATA CATCGAGACTNNNTGCATCAGGT | 6960 | TGCAGGACCAGAGAATTCGAATA CACATTACTTNNNTGCATCAGGT | 7200 |
| TGCAGGACCAGAGAATTCGAATA CATAATCCAANNNTGCATCAGGT | 6721 | TGCAGGACCAGAGAATTCGAATA CACACACTTCNNNTGCATCAGGT | 6961 | TGCAGGACCAGAGAATTCGAATA CACCAAGACTNNNTGCATCAGGT | 7201 |
| TGCAGGACCAGAGAATTCGAATA CACGTACAACNNNTGCATCAGGT | 6722 | TGCAGGACCAGAGAATTCGAATA CAAAAAAACCNNNTGCATCAGGT | 6962 | TGCAGGACCAGAGAATTCGAATA CAAGTTCCAGNNNTGCATCAGGT | 7202 |
| TGCAGGACCAGAGAATTCGAATA CAATATTCCANNNTGCATCAGGT | 6723 | TGCAGGACCAGAGAATTCGAATA CATACAGCCANNNTGCATCAGGT | 6963 | TGCAGGACCAGAGAATTCGAATA CAAACCAGTCNNNTGCATCAGGT | 7203 |
| TGCAGGACCAGAGAATTCGAATA CATAATTATANNNTGCATCAGGT | 6724 | TGCAGGACCAGAGAATTCGAATA CAATGAAAACNNNTGCATCAGGT | 6964 | TGCAGGACCAGAGAATTCGAATA CATGGCTCAANNNTGCATCAGGT | 7204 |
| TGCAGGACCAGAGAATTCGAATA CAGATGCAGANNNTGCATCAGGT | 6725 | TGCAGGACCAGAGAATTCGAATA CAGTGATGCTNNNTGCATCAGGT | 6965 | TGCAGGACCAGAGAATTCGAATA CATCTTTATGNNNTGCATCAGGT | 7205 |
| TGCAGGACCAGAGAATTCGAATA CAGGAGCCAGNNNTGCATCAGGT | 6726 | TGCAGGACCAGAGAATTCGAATA CATTAACAGTNNNTGCATCAGGT | 6966 | TGCAGGACCAGAGAATTCGAATA CAGGTGACTTNNNTGCATCAGGT | 7206 |
| TGCAGGACCAGAGAATTCGAATA CAGCGAGTTTNNNTGCATCAGGT | 6727 | TGCAGGACCAGAGAATTCGAATA CACACCGCGNNNNTGCATCAGGT | 6967 | TGCAGGACCAGAGAATTCGAATA CATCCTAACCNNNTGCATCAGGT | 7207 |
| TGCAGGACCAGAGAATTCGAATA CAAAGTGACGNNNTGCATCAGGT | 6728 | TGCAGGACCAGAGAATTCGAATA CATGTGCCCCNNNTGCATCAGGT | 6968 | TGCAGGACCAGAGAATTCGAATA CAGCGTAAAGNNNTGCATCAGGT | 7208 |

FIG. 22A

| Pool-31 | SEQ ID NO: | Pool-32 | SEQ ID NO: |
|---|---|---|---|
| TGCAGGACCAGAGAATTCGAATACATGGTCCAANNNACGTATGCCA | 7209 | TGCAGGACCAGAGAATTCGAATACATTCCAATTNNNACGTATGCCA | 7449 |
| TGCAGGACCAGAGAATTCGAATACAGTACTCAGNNNACGTATGCCA | 7210 | TGCAGGACCAGAGAATTCGAATACATGTACAGCNNNACGTATGCCA | 7450 |
| TGCAGGACCAGAGAATTCGAATACAGAAGCCCCNNNACGTATGCCA | 7211 | TGCAGGACCAGAGAATTCGAATACACAGGAGCGNNNACGTATGCCA | 7451 |
| TGCAGGACCAGAGAATTCGAATACATTAACCGGNNNACGTATGCCA | 7212 | TGCAGGACCAGAGAATTCGAATACAATGCGTTGNNNACGTATGCCA | 7452 |
| TGCAGGACCAGAGAATTCGAATACATAACCTGGNNNACGTATGCCA | 7213 | TGCAGGACCAGAGAATTCGAATACATATATTTCGNNNACGTATGCCA | 7453 |
| TGCAGGACCAGAGAATTCGAATACAGTCGACTANNNACGTATGCCA | 7214 | TGCAGGACCAGAGAATTCGAATACAAAATTCCCCNNNACGTATGCCA | 7454 |
| TGCAGGACCAGAGAATTCGAATACACCAAACGTNNNACGTATGCCA | 7215 | TGCAGGACCAGAGAATTCGAATACATCTGACGANNNACGTATGCCA | 7455 |
| TGCAGGACCAGAGAATTCGAATACAACGTATCGNNNACGTATGCCA | 7216 | TGCAGGACCAGAGAATTCGAATACACCGCGCTTNNNACGTATGCCA | 7456 |
| TGCAGGACCAGAGAATTCGAATACACACGGCCANNNACGTATGCCA | 7217 | TGCAGGACCAGAGAATTCGAATACAAAACACCCNNNACGTATGCCA | 7457 |
| TGCAGGACCAGAGAATTCGAATACAAGGTTTGCNNNACGTATGCCA | 7218 | TGCAGGACCAGAGAATTCGAATACAGGTTGTGNNNACGTATGCCA | 7458 |
| TGCAGGACCAGAGAATTCGAATACACGACGCGTNNNACGTATGCCA | 7219 | TGCAGGACCAGAGAATTCGAATACAACTAACCGNNNACGTATGCCA | 7459 |
| TGCAGGACCAGAGAATTCGAATACACCGACGTGNNNACGTATGCCA | 7220 | TGCAGGACCAGAGAATTCGAATACATCAGGAGANNNACGTATGCCA | 7460 |
| TGCAGGACCAGAGAATTCGAATACACAGTTTTTNNNACGTATGCCA | 7221 | TGCAGGACCAGAGAATTCGAATACAGTCTGCGGNNNACGTATGCCA | 7461 |
| TGCAGGACCAGAGAATTCGAATACATGCCCGGANNNACGTATGCCA | 7222 | TGCAGGACCAGAGAATTCGAATACAACTGGCGCNNNACGTATGCCA | 7462 |
| TGCAGGACCAGAGAATTCGAATACAGCCACTCCNNNACGTATGCCA | 7223 | TGCAGGACCAGAGAATTCGAATACACGACTCTTNNNACGTATGCCA | 7463 |
| TGCAGGACCAGAGAATTCGAATACAGACGAAGTNNNACGTATGCCA | 7224 | TGCAGGACCAGAGAATTCGAATACAGCGAAGGCNNNACGTATGCCA | 7464 |
| TGCAGGACCAGAGAATTCGAATACAGGTTCCTTNNNACGTATGCCA | 7225 | TGCAGGACCAGAGAATTCGAATACAGGCGCCGCNNNACGTATGCCA | 7465 |
| TGCAGGACCAGAGAATTCGAATACACCGGAATTNNNACGTATGCCA | 7226 | TGCAGGACCAGAGAATTCGAATACAGAGCACCCNNNACGTATGCCA | 7466 |
| TGCAGGACCAGAGAATTCGAATACATCGGCAGCNNNACGTATGCCA | 7227 | TGCAGGACCAGAGAATTCGAATACACCCAAAGTNNNACGTATGCCA | 7467 |
| TGCAGGACCAGAGAATTCGAATACAGCTAGAGANNNACGTATGCCA | 7228 | TGCAGGACCAGAGAATTCGAATACACGGAATAGNNNACGTATGCCA | 7468 |
| TGCAGGACCAGAGAATTCGAATACACCACTTACNNNACGTATGCCA | 7229 | TGCAGGACCAGAGAATTCGAATACAAGTAAGATNNNACGTATGCCA | 7469 |
| TGCAGGACCAGAGAATTCGAATACAACCACCGGNNNACGTATGCCA | 7230 | TGCAGGACCAGAGAATTCGAATACATCTCACACNNNACGTATGCCA | 7470 |
| TGCAGGACCAGAGAATTCGAATACAGAAACATANNNACGTATGCCA | 7231 | TGCAGGACCAGAGAATTCGAATACAGGCCCAANNNACGTATGCCA | 7471 |
| TGCAGGACCAGAGAATTCGAATACAGCTGAAAGNNNACGTATGCCA | 7232 | TGCAGGACCAGAGAATTCGAATACAGGATTTGCNNNACGTATGCCA | 7472 |
| TGCAGGACCAGAGAATTCGAATACATAAGAAGTNNNACGTATGCCA | 7233 | TGCAGGACCAGAGAATTCGAATACAAATGACAANNNACGTATGCCA | 7473 |
| TGCAGGACCAGAGAATTCGAATACACGTGACTANNNACGTATGCCA | 7234 | TGCAGGACCAGAGAATTCGAATACATAAAAAATNNNACGTATGCCA | 7474 |
| TGCAGGACCAGAGAATTCGAATACATTAAGATCNNNACGTATGCCA | 7235 | TGCAGGACCAGAGAATTCGAATACATAATGGCNNNACGTATGCCA | 7475 |
| TGCAGGACCAGAGAATTCGAATACATGGATCACNNNACGTATGCCA | 7236 | TGCAGGACCAGAGAATTCGAATACAGTTGCTTCNNNACGTATGCCA | 7476 |
| TGCAGGACCAGAGAATTCGAATACACCGAGCTGNNNACGTATGCCA | 7237 | TGCAGGACCAGAGAATTCGAATACACGTTTCACNNNACGTATGCCA | 7477 |
| TGCAGGACCAGAGAATTCGAATACACTCATAAANNNACGTATGCCA | 7238 | TGCAGGACCAGAGAATTCGAATACAGAACAAATNNNACGTATGCCA | 7478 |
| TGCAGGACCAGAGAATTCGAATACACTCTACTGNNNACGTATGCCA | 7239 | TGCAGGACCAGAGAATTCGAATACAATAGAAGTNNNACGTATGCCA | 7479 |
| TGCAGGACCAGAGAATTCGAATACAAGGTGAGTNNNACGTATGCCA | 7240 | TGCAGGACCAGAGAATTCGAATACAGTAAGGCANNNACGTATGCCA | 7480 |
| TGCAGGACCAGAGAATTCGAATACAGAACACTCNNNACGTATGCCA | 7241 | TGCAGGACCAGAGAATTCGAATACAGAGATGCANNNACGTATGCCA | 7481 |

FIG. 22B

| Pool-31 | SEQ ID NO: | Pool-32 | SEQ ID NO: |
|---|---|---|---|
| TGCAGGACCAGAGAATTCGAATACAGGCAGAGCNNNACGTATGCCA | 7242 | TGCAGGACCAGAGAATTCGAATACACACCATCTNNNACGTATGCCA | 7482 |
| TGCAGGACCAGAGAATTCGAATACATTTCCAGCNNNACGTATGCCA | 7243 | TGCAGGACCAGAGAATTCGAATACAGATACACCNNNACGTATGCCA | 7483 |
| TGCAGGACCAGAGAATTCGAATACACCCATCATNNNACGTATGCCA | 7244 | TGCAGGACCAGAGAATTCGAATACAGATACTGCNNNACGTATGCCA | 7484 |
| TGCAGGACCAGAGAATTCGAATACAATCAGCGTNNNACGTATGCCA | 7245 | TGCAGGACCAGAGAATTCGAATACACGTAACTGNNNACGTATGCCA | 7485 |
| TGCAGGACCAGAGAATTCGAATACATGAAAAACNNNACGTATGCCA | 7246 | TGCAGGACCAGAGAATTCGAATACATCCTCTTCNNNACGTATGCCA | 7486 |
| TGCAGGACCAGAGAATTCGAATACAATGCGGAANNNACGTATGCCA | 7247 | TGCAGGACCAGAGAATTCGAATACATCGCGTCGNNNACGTATGCCA | 7487 |
| TGCAGGACCAGAGAATTCGAATACACGGATTCANNNACGTATGCCA | 7248 | TGCAGGACCAGAGAATTCGAATACAACAGGAACNNNACGTATGCCA | 7488 |
| TGCAGGACCAGAGAATTCGAATACAGTCATACGNNNACGTATGCCA | 7249 | TGCAGGACCAGAGAATTCGAATACAAAAATTTNNNACGTATGCCA | 7489 |
| TGCAGGACCAGAGAATTCGAATACAACCTGCTTNNNACGTATGCCA | 7250 | TGCAGGACCAGAGAATTCGAATACAAAGTCACCNNNACGTATGCCA | 7490 |
| TGCAGGACCAGAGAATTCGAATACAGTTGTGCANNNACGTATGCCA | 7251 | TGCAGGACCAGAGAATTCGAATACATCTACGAGNNNACGTATGCCA | 7491 |
| TGCAGGACCAGAGAATTCGAATACAGAAATCGGNNNACGTATGCCA | 7252 | TGCAGGACCAGAGAATTCGAATACAGATCTTCCNNNACGTATGCCA | 7492 |
| TGCAGGACCAGAGAATTCGAATACAAAGTTAGANNNACGTATGCCA | 7253 | TGCAGGACCAGAGAATTCGAATACAGGACACCNNNACGTATGCCA | 7493 |
| TGCAGGACCAGAGAATTCGAATACATGTAACGCNNNACGTATGCCA | 7254 | TGCAGGACCAGAGAATTCGAATACAATAGGTGGNNNACGTATGCCA | 7494 |
| TGCAGGACCAGAGAATTCGAATACAGTTTTGAANNNACGTATGCCA | 7255 | TGCAGGACCAGAGAATTCGAATACACCATCGCCNNNACGTATGCCA | 7495 |
| TGCAGGACCAGAGAATTCGAATACACAAACTGCNNNACGTATGCCA | 7256 | TGCAGGACCAGAGAATTCGAATACATGATCTCCNNNACGTATGCCA | 7496 |
| TGCAGGACCAGAGAATTCGAATACAGCCTGAGCNNNACGTATGCCA | 7257 | TGCAGGACCAGAGAATTCGAATACACGCGAATTNNNACGTATGCCA | 7497 |
| TGCAGGACCAGAGAATTCGAATACATCTTCCAGNNNACGTATGCCA | 7258 | TGCAGGACCAGAGAATTCGAATACATATATAATNNNACGTATGCCA | 7498 |
| TGCAGGACCAGAGAATTCGAATACATACCCTACNNNACGTATGCCA | 7259 | TGCAGGACCAGAGAATTCGAATACATATCGCCTNNNACGTATGCCA | 7499 |
| TGCAGGACCAGAGAATTCGAATACATCATAGATNNNACGTATGCCA | 7260 | TGCAGGACCAGAGAATTCGAATACATTACGAGCNNNACGTATGCCA | 7500 |
| TGCAGGACCAGAGAATTCGAATACAGTATAGAANNNACGTATGCCA | 7261 | TGCAGGACCAGAGAATTCGAATACAGGTTTCTCNNNACGTATGCCA | 7501 |
| TGCAGGACCAGAGAATTCGAATACACCCTAAAGNNNACGTATGCCA | 7262 | TGCAGGACCAGAGAATTCGAATACACTTGCAGANNNACGTATGCCA | 7502 |
| TGCAGGACCAGAGAATTCGAATACAGCGGTTTANNNACGTATGCCA | 7263 | TGCAGGACCAGAGAATTCGAATACAGACATTTANNNACGTATGCCA | 7503 |
| TGCAGGACCAGAGAATTCGAATACATAGCTCAGNNNACGTATGCCA | 7264 | TGCAGGACCAGAGAATTCGAATACAACACGAGANNNACGTATGCCA | 7504 |
| TGCAGGACCAGAGAATTCGAATACACCGTCCCANNNACGTATGCCA | 7265 | TGCAGGACCAGAGAATTCGAATACATTGCCCGCNNNACGTATGCCA | 7505 |
| TGCAGGACCAGAGAATTCGAATACAAGTGCGAANNNACGTATGCCA | 7266 | TGCAGGACCAGAGAATTCGAATACACAGTCCTTNNNACGTATGCCA | 7506 |
| TGCAGGACCAGAGAATTCGAATACATGAGCTTGNNNACGTATGCCA | 7267 | TGCAGGACCAGAGAATTCGAATACAGCATTTGGNNNACGTATGCCA | 7507 |
| TGCAGGACCAGAGAATTCGAATACATATCGTGGNNNACGTATGCCA | 7268 | TGCAGGACCAGAGAATTCGAATACAGGATATCCNNNACGTATGCCA | 7508 |
| TGCAGGACCAGAGAATTCGAATACATCAGACACNNNCTAGCGTTAC | 7269 | TGCAGGACCAGAGAATTCGAATACACCAGGAGGNNNCTAGCGTTAC | 7509 |
| TGCAGGACCAGAGAATTCGAATACATACCCTTGNNNCTAGCGTTAC | 7270 | TGCAGGACCAGAGAATTCGAATACATCGCCTTANNNCTAGCGTTAC | 7510 |
| TGCAGGACCAGAGAATTCGAATACACATCGAGTNNNCTAGCGTTAC | 7271 | TGCAGGACCAGAGAATTCGAATACATTACCCGTNNNCTAGCGTTAC | 7511 |
| TGCAGGACCAGAGAATTCGAATACATGAATCTANNNCTAGCGTTAC | 7272 | TGCAGGACCAGAGAATTCGAATACAATCACCTCNNNCTAGCGTTAC | 7512 |
| TGCAGGACCAGAGAATTCGAATACAAGTGGAGTNNNCTAGCGTTAC | 7273 | TGCAGGACCAGAGAATTCGAATACACCAATTCCNNNCTAGCGTTAC | 7513 |
| TGCAGGACCAGAGAATTCGAATACACTGAAGGANNNCTAGCGTTAC | 7274 | TGCAGGACCAGAGAATTCGAATACATGCGTGATNNNCTAGCGTTAC | 7514 |

FIG. 22C

| Pool-31 | SEQ ID NO: | Pool-32 | SEQ ID NO: |
|---|---|---|---|
| TGCAGGACCAGAGAATTCGAATACAAATCAGTTNNNCTAGCGTTAC | 7275 | TGCAGGACCAGAGAATTCGAATACACTCGGCCTNNNCTAGCGTTAC | 7515 |
| TGCAGGACCAGAGAATTCGAATACACGCAGGCTNNNCTAGCGTTAC | 7276 | TGCAGGACCAGAGAATTCGAATACAACGAATTANNNCTAGCGTTAC | 7516 |
| TGCAGGACCAGAGAATTCGAATACACGGTGCACNNNCTAGCGTTAC | 7277 | TGCAGGACCAGAGAATTCGAATACACCCTACATNNNCTAGCGTTAC | 7517 |
| TGCAGGACCAGAGAATTCGAATACACGTATCAGNNNCTAGCGTTAC | 7278 | TGCAGGACCAGAGAATTCGAATACACGGTTTAGNNNCTAGCGTTAC | 7518 |
| TGCAGGACCAGAGAATTCGAATACATAACGCTGNNNCTAGCGTTAC | 7279 | TGCAGGACCAGAGAATTCGAATACATCGTATAANNNCTAGCGTTAC | 7519 |
| TGCAGGACCAGAGAATTCGAATACAACCGTACANNNCTAGCGTTAC | 7280 | TGCAGGACCAGAGAATTCGAATACATAAGCAAANNNCTAGCGTTAC | 7520 |
| TGCAGGACCAGAGAATTCGAATACAGCTTAGTGNNNCTAGCGTTAC | 7281 | TGCAGGACCAGAGAATTCGAATACACGGTCTGGNNNCTAGCGTTAC | 7521 |
| TGCAGGACCAGAGAATTCGAATACACGAACGCCNNNCTAGCGTTAC | 7282 | TGCAGGACCAGAGAATTCGAATACACCACAGTANNNCTAGCGTTAC | 7522 |
| TGCAGGACCAGAGAATTCGAATACAGTATCGTGNNNCTAGCGTTAC | 7283 | TGCAGGACCAGAGAATTCGAATACAACCACTAGNNNCTAGCGTTAC | 7523 |
| TGCAGGACCAGAGAATTCGAATACATACAAATCNNNCTAGCGTTAC | 7284 | TGCAGGACCAGAGAATTCGAATACACGCAAACTNNNCTAGCGTTAC | 7524 |
| TGCAGGACCAGAGAATTCGAATACACGTCCTTANNNCTAGCGTTAC | 7285 | TGCAGGACCAGAGAATTCGAATACACTTCAACCNNNCTAGCGTTAC | 7525 |
| TGCAGGACCAGAGAATTCGAATACAAGACCACTNNNCTAGCGTTAC | 7286 | TGCAGGACCAGAGAATTCGAATACAGAGAGGCCNNNCTAGCGTTAC | 7526 |
| TGCAGGACCAGAGAATTCGAATACAACAAGGTGNNNCTAGCGTTAC | 7287 | TGCAGGACCAGAGAATTCGAATACAATATTGGTNNNCTAGCGTTAC | 7527 |
| TGCAGGACCAGAGAATTCGAATACAATACTTGANNNCTAGCGTTAC | 7288 | TGCAGGACCAGAGAATTCGAATACACTATATGANNNCTAGCGTTAC | 7528 |
| TGCAGGACCAGAGAATTCGAATACACTTCCGATNNNCTAGCGTTAC | 7289 | TGCAGGACCAGAGAATTCGAATACAATCTTGTTNNNCTAGCGTTAC | 7529 |
| TGCAGGACCAGAGAATTCGAATACACGTCTTGTNNNCTAGCGTTAC | 7290 | TGCAGGACCAGAGAATTCGAATACATAAAGGCGNNNCTAGCGTTAC | 7530 |
| TGCAGGACCAGAGAATTCGAATACAAAGTGGTGNNNCTAGCGTTAC | 7291 | TGCAGGACCAGAGAATTCGAATACACCATTTGCNNNCTAGCGTTAC | 7531 |
| TGCAGGACCAGAGAATTCGAATACATCGGTGGCNNNCTAGCGTTAC | 7292 | TGCAGGACCAGAGAATTCGAATACATACCCCTANNNCTAGCGTTAC | 7532 |
| TGCAGGACCAGAGAATTCGAATACAAAAATCAGNNNCTAGCGTTAC | 7293 | TGCAGGACCAGAGAATTCGAATACAAGAACCGANNNCTAGCGTTAC | 7533 |
| TGCAGGACCAGAGAATTCGAATACATCCCGCGTNNNCTAGCGTTAC | 7294 | TGCAGGACCAGAGAATTCGAATACAACGATAGGNNNCTAGCGTTAC | 7534 |
| TGCAGGACCAGAGAATTCGAATACAGGCACGCTNNNCTAGCGTTAC | 7295 | TGCAGGACCAGAGAATTCGAATACAGGCGCCATNNNCTAGCGTTAC | 7535 |
| TGCAGGACCAGAGAATTCGAATACAGCTGTCTTNNNCTAGCGTTAC | 7296 | TGCAGGACCAGAGAATTCGAATACAAAAATCTCNNNCTAGCGTTAC | 7536 |
| TGCAGGACCAGAGAATTCGAATACAAGCATAAANNNCTAGCGTTAC | 7297 | TGCAGGACCAGAGAATTCGAATACAGACTAGCTNNNCTAGCGTTAC | 7537 |
| TGCAGGACCAGAGAATTCGAATACATGCGAATCNNNCTAGCGTTAC | 7298 | TGCAGGACCAGAGAATTCGAATACACGTGAGTTNNNCTAGCGTTAC | 7538 |
| TGCAGGACCAGAGAATTCGAATACACGTTTCGTNNNCTAGCGTTAC | 7299 | TGCAGGACCAGAGAATTCGAATACACCCGCTGTNNNCTAGCGTTAC | 7539 |
| TGCAGGACCAGAGAATTCGAATACAGCACTCTTNNNCTAGCGTTAC | 7300 | TGCAGGACCAGAGAATTCGAATACAAAAACTTCNNNCTAGCGTTAC | 7540 |
| TGCAGGACCAGAGAATTCGAATACACTCGCTGCNNNCTAGCGTTAC | 7301 | TGCAGGACCAGAGAATTCGAATACAAGTAACGGNNNCTAGCGTTAC | 7541 |
| TGCAGGACCAGAGAATTCGAATACACATACAGCNNNCTAGCGTTAC | 7302 | TGCAGGACCAGAGAATTCGAATACAATCAACATNNNCTAGCGTTAC | 7542 |
| TGCAGGACCAGAGAATTCGAATACAGAGCAAACNNNCTAGCGTTAC | 7303 | TGCAGGACCAGAGAATTCGAATACACTTTTGATNNNCTAGCGTTAC | 7543 |
| TGCAGGACCAGAGAATTCGAATACAGCTTCCATNNNCTAGCGTTAC | 7304 | TGCAGGACCAGAGAATTCGAATACAGTGTACCANNNCTAGCGTTAC | 7544 |
| TGCAGGACCAGAGAATTCGAATACACCTAATTTNNNCTAGCGTTAC | 7305 | TGCAGGACCAGAGAATTCGAATACATGCACACANNNCTAGCGTTAC | 7545 |
| TGCAGGACCAGAGAATTCGAATACAAGCCCGACNNNCTAGCGTTAC | 7306 | TGCAGGACCAGAGAATTCGAATACATATACTTCNNNCTAGCGTTAC | 7546 |
| TGCAGGACCAGAGAATTCGAATACATGGTGAAGNNNCTAGCGTTAC | 7307 | TGCAGGACCAGAGAATTCGAATACAGAAACTAANNNCTAGCGTTAC | 7547 |

FIG. 22D

| Pool-31 | SEQ ID NO: | Pool-32 | SEQ ID NO: |
|---|---|---|---|
| TGCAGGACCAGAGAATTCGAATACAATCGCTGANNNCTAGCGTTAC | 7308 | TGCAGGACCAGAGAATTCGAATACAATCTCGAGNNNCTAGCGTTAC | 7548 |
| TGCAGGACCAGAGAATTCGAATACATTACTGCCNNNCTAGCGTTAC | 7309 | TGCAGGACCAGAGAATTCGAATACAATGTCTGGNNNCTAGCGTTAC | 7549 |
| TGCAGGACCAGAGAATTCGAATACAGGAGGCCANNNCTAGCGTTAC | 7310 | TGCAGGACCAGAGAATTCGAATACAAGACATGGNNNCTAGCGTTAC | 7550 |
| TGCAGGACCAGAGAATTCGAATACATACCTGTCNNNCTAGCGTTAC | 7311 | TGCAGGACCAGAGAATTCGAATACACGGCAATTNNNCTAGCGTTAC | 7551 |
| TGCAGGACCAGAGAATTCGAATACAATATGCTANNNCTAGCGTTAC | 7312 | TGCAGGACCAGAGAATTCGAATACATAATGTTGNNNCTAGCGTTAC | 7552 |
| TGCAGGACCAGAGAATTCGAATACAGATCACCANNNCTAGCGTTAC | 7313 | TGCAGGACCAGAGAATTCGAATACAGCGAGGACNNNCTAGCGTTAC | 7553 |
| TGCAGGACCAGAGAATTCGAATACAGCGGAACGNNNCTAGCGTTAC | 7314 | TGCAGGACCAGAGAATTCGAATACACGAACATCNNNCTAGCGTTAC | 7554 |
| TGCAGGACCAGAGAATTCGAATACAAATCCTTTNNNCTAGCGTTAC | 7315 | TGCAGGACCAGAGAATTCGAATACAGCATGTACNNNCTAGCGTTAC | 7555 |
| TGCAGGACCAGAGAATTCGAATACATACTATAGNNNCTAGCGTTAC | 7316 | TGCAGGACCAGAGAATTCGAATACAGCAACTGTNNNCTAGCGTTAC | 7556 |
| TGCAGGACCAGAGAATTCGAATACAGTCTGTAGNNNCTAGCGTTAC | 7317 | TGCAGGACCAGAGAATTCGAATACAGTACTCTCNNNCTAGCGTTAC | 7557 |
| TGCAGGACCAGAGAATTCGAATACAGACTATCGNNNCTAGCGTTAC | 7318 | TGCAGGACCAGAGAATTCGAATACAGGCTAAAGNNNCTAGCGTTAC | 7558 |
| TGCAGGACCAGAGAATTCGAATACAAGGATTAANNNCTAGCGTTAC | 7319 | TGCAGGACCAGAGAATTCGAATACACCCTTTGANNNCTAGCGTTAC | 7559 |
| TGCAGGACCAGAGAATTCGAATACATTACATCTNNNCTAGCGTTAC | 7320 | TGCAGGACCAGAGAATTCGAATACACGGAGGAGNNNCTAGCGTTAC | 7560 |
| TGCAGGACCAGAGAATTCGAATACATTTGGCAGNNNCTAGCGTTAC | 7321 | TGCAGGACCAGAGAATTCGAATACAGTAAGAATNNNCTAGCGTTAC | 7561 |
| TGCAGGACCAGAGAATTCGAATACACAGTATGCNNNCTAGCGTTAC | 7322 | TGCAGGACCAGAGAATTCGAATACATGATTACANNNCTAGCGTTAC | 7562 |
| TGCAGGACCAGAGAATTCGAATACATTCGATCCNNNCTAGCGTTAC | 7323 | TGCAGGACCAGAGAATTCGAATACACAAAAATGNNNCTAGCGTTAC | 7563 |
| TGCAGGACCAGAGAATTCGAATACAAATCCCCTNNNCTAGCGTTAC | 7324 | TGCAGGACCAGAGAATTCGAATACACCGTGGTGNNNCTAGCGTTAC | 7564 |
| TGCAGGACCAGAGAATTCGAATACACTCTCCCCNNNCTAGCGTTAC | 7325 | TGCAGGACCAGAGAATTCGAATACAAACGTTATNNNCTAGCGTTAC | 7565 |
| TGCAGGACCAGAGAATTCGAATACACAATTAACNNNCTAGCGTTAC | 7326 | TGCAGGACCAGAGAATTCGAATACAGCTTGCAANNNCTAGCGTTAC | 7566 |
| TGCAGGACCAGAGAATTCGAATACAATTTTGCTNNNCTAGCGTTAC | 7327 | TGCAGGACCAGAGAATTCGAATACATTAGTCGGNNNCTAGCGTTAC | 7567 |
| TGCAGGACCAGAGAATTCGAATACAATAAATCCNNNCTAGCGTTAC | 7328 | TGCAGGACCAGAGAATTCGAATACAACGGCCGTNNNCTAGCGTTAC | 7568 |
| TGCAGGACCAGAGAATTCGAATACATACTCGTCNNNGATCGACATG | 7329 | TGCAGGACCAGAGAATTCGAATACAGCGTGAAANNNGATCGACATG | 7569 |
| TGCAGGACCAGAGAATTCGAATACAATGCGAAGNNNGATCGACATG | 7330 | TGCAGGACCAGAGAATTCGAATACATGCCTGCCNNNGATCGACATG | 7570 |
| TGCAGGACCAGAGAATTCGAATACATGCCAGCNNNGATCGACATG | 7331 | TGCAGGACCAGAGAATTCGAATACATCGACGCGNNNGATCGACATG | 7571 |
| TGCAGGACCAGAGAATTCGAATACATGGTAAAANNNGATCGACATG | 7332 | TGCAGGACCAGAGAATTCGAATACATCATCCTGNNNGATCGACATG | 7572 |
| TGCAGGACCAGAGAATTCGAATACACACTCCATNNNGATCGACATG | 7333 | TGCAGGACCAGAGAATTCGAATACAGTCAGTCANNNGATCGACATG | 7573 |
| TGCAGGACCAGAGAATTCGAATACACCTATGCANNNGATCGACATG | 7334 | TGCAGGACCAGAGAATTCGAATACACCGGTGACNNNGATCGACATG | 7574 |
| TGCAGGACCAGAGAATTCGAATACAATGCTCCTNNNGATCGACATG | 7335 | TGCAGGACCAGAGAATTCGAATACATATCGCGANNNGATCGACATG | 7575 |
| TGCAGGACCAGAGAATTCGAATACAGATTGAAANNNGATCGACATG | 7336 | TGCAGGACCAGAGAATTCGAATACAGACGCGTCNNNGATCGACATG | 7576 |
| TGCAGGACCAGAGAATTCGAATACAACACCCAANNNGATCGACATG | 7337 | TGCAGGACCAGAGAATTCGAATACAGAACAGACNNNGATCGACATG | 7577 |
| TGCAGGACCAGAGAATTCGAATACACCGGCATGNNNGATCGACATG | 7338 | TGCAGGACCAGAGAATTCGAATACAGTGTGTNNNGATCGACATG | 7578 |
| TGCAGGACCAGAGAATTCGAATACATCCGATTCNNNGATCGACATG | 7339 | TGCAGGACCAGAGAATTCGAATACAGATTGCGNNNGATCGACATG | 7579 |
| TGCAGGACCAGAGAATTCGAATACAGAATCCTGNNNGATCGACATG | 7340 | TGCAGGACCAGAGAATTCGAATACAGTAGATTTNNNGATCGACATG | 7580 |

FIG. 22E

| Pool-31 | SEQ ID NO: | Pool-32 | SEQ ID NO: |
|---|---|---|---|
| TGCAGGACCAGAGAATTCGAATACATTTCGTCGNNNGATCGACATG | 7341 | TGCAGGACCAGAGAATTCGAATACAGCTTGAGTNNNGATCGACATG | 7581 |
| TGCAGGACCAGAGAATTCGAATACACTTCACTGNNNGATCGACATG | 7342 | TGCAGGACCAGAGAATTCGAATACACGCAACGCNNNGATCGACATG | 7582 |
| TGCAGGACCAGAGAATTCGAATACACCCTATTGNNNGATCGACATG | 7343 | TGCAGGACCAGAGAATTCGAATACACCTAATGGNNNGATCGACATG | 7583 |
| TGCAGGACCAGAGAATTCGAATACAAGTAGTAANNNGATCGACATG | 7344 | TGCAGGACCAGAGAATTCGAATACAGACAGGATNNNGATCGACATG | 7584 |
| TGCAGGACCAGAGAATTCGAATACACACCGTAANNNGATCGACATG | 7345 | TGCAGGACCAGAGAATTCGAATACACTTCCCTTNNNGATCGACATG | 7585 |
| TGCAGGACCAGAGAATTCGAATACATGTTTCCGNNNGATCGACATG | 7346 | TGCAGGACCAGAGAATTCGAATACATAAGAGATNNNGATCGACATG | 7586 |
| TGCAGGACCAGAGAATTCGAATACAGCTGGACCNNNGATCGACATG | 7347 | TGCAGGACCAGAGAATTCGAATACAACCGAATCNNNGATCGACATG | 7587 |
| TGCAGGACCAGAGAATTCGAATACAGTAATTGTNNNGATCGACATG | 7348 | TGCAGGACCAGAGAATTCGAATACAGCCAACATNNNGATCGACATG | 7588 |
| TGCAGGACCAGAGAATTCGAATACAAGCTTATANNNGATCGACATG | 7349 | TGCAGGACCAGAGAATTCGAATACATGGCTAACNNNGATCGACATG | 7589 |
| TGCAGGACCAGAGAATTCGAATACAGCTACCAANNNGATCGACATG | 7350 | TGCAGGACCAGAGAATTCGAATACATCGTTCGTNNNGATCGACATG | 7590 |
| TGCAGGACCAGAGAATTCGAATACAGATAATGANNNGATCGACATG | 7351 | TGCAGGACCAGAGAATTCGAATACACAGTTGCANNNGATCGACATG | 7591 |
| TGCAGGACCAGAGAATTCGAATACAAAATCATCNNNGATCGACATG | 7352 | TGCAGGACCAGAGAATTCGAATACAACTAGCTGNNNGATCGACATG | 7592 |
| TGCAGGACCAGAGAATTCGAATACAAATAGCCCNNNGATCGACATG | 7353 | TGCAGGACCAGAGAATTCGAATACAAAACTAAGNNNGATCGACATG | 7593 |
| TGCAGGACCAGAGAATTCGAATACATGCTGCTTNNNGATCGACATG | 7354 | TGCAGGACCAGAGAATTCGAATACAGTTCGAGNNNGATCGACATG | 7594 |
| TGCAGGACCAGAGAATTCGAATACATTACGCAGNNNGATCGACATG | 7355 | TGCAGGACCAGAGAATTCGAATACACTCATAGGNNNGATCGACATG | 7595 |
| TGCAGGACCAGAGAATTCGAATACACCCAGCCTNNNGATCGACATG | 7356 | TGCAGGACCAGAGAATTCGAATACAGCAGTATCNNNGATCGACATG | 7596 |
| TGCAGGACCAGAGAATTCGAATACACCATTTATNNNGATCGACATG | 7357 | TGCAGGACCAGAGAATTCGAATACATATAGTCANNNGATCGACATG | 7597 |
| TGCAGGACCAGAGAATTCGAATACAGTGCAATCNNNGATCGACATG | 7358 | TGCAGGACCAGAGAATTCGAATACAGGTGTAAGNNNGATCGACATG | 7598 |
| TGCAGGACCAGAGAATTCGAATACACATCAGGTNNNGATCGACATG | 7359 | TGCAGGACCAGAGAATTCGAATACAAGTGAAATNNNGATCGACATG | 7599 |
| TGCAGGACCAGAGAATTCGAATACAGGCCCACANNNGATCGACATG | 7360 | TGCAGGACCAGAGAATTCGAATACAGGTCGTTANNNGATCGACATG | 7600 |
| TGCAGGACCAGAGAATTCGAATACAAAGCACGANNNGATCGACATG | 7361 | TGCAGGACCAGAGAATTCGAATACATCGCGCCTNNNGATCGACATG | 7601 |
| TGCAGGACCAGAGAATTCGAATACACACAGGAANNNGATCGACATG | 7362 | TGCAGGACCAGAGAATTCGAATACAAAGAAACTNNNGATCGACATG | 7602 |
| TGCAGGACCAGAGAATTCGAATACAGCAGCCTGNNNGATCGACATG | 7363 | TGCAGGACCAGAGAATTCGAATACATCCTTTCCNNNGATCGACATG | 7603 |
| TGCAGGACCAGAGAATTCGAATACAGGCTGCGTNNNGATCGACATG | 7364 | TGCAGGACCAGAGAATTCGAATACATGGCGTCGNNNGATCGACATG | 7604 |
| TGCAGGACCAGAGAATTCGAATACACTCTAGCTNNNGATCGACATG | 7365 | TGCAGGACCAGAGAATTCGAATACAGGCTGTCGNNNGATCGACATG | 7605 |
| TGCAGGACCAGAGAATTCGAATACAGAAGGCTANNNGATCGACATG | 7366 | TGCAGGACCAGAGAATTCGAATACATGTCCATCNNNGATCGACATG | 7606 |
| TGCAGGACCAGAGAATTCGAATACATATCTGAANNNGATCGACATG | 7367 | TGCAGGACCAGAGAATTCGAATACAGTGGAAGNNNGATCGACATG | 7607 |
| TGCAGGACCAGAGAATTCGAATACATACTATTCNNNGATCGACATG | 7368 | TGCAGGACCAGAGAATTCGAATACAGTGGACGGNNNGATCGACATG | 7608 |
| TGCAGGACCAGAGAATTCGAATACACATGACCANNNGATCGACATG | 7369 | TGCAGGACCAGAGAATTCGAATACATCCTGGCCNNNGATCGACATG | 7609 |
| TGCAGGACCAGAGAATTCGAATACAATTCAGGCNNNGATCGACATG | 7370 | TGCAGGACCAGAGAATTCGAATACAATAGGCGANNNGATCGACATG | 7610 |
| TGCAGGACCAGAGAATTCGAATACAAACCAACCNNNGATCGACATG | 7371 | TGCAGGACCAGAGAATTCGAATACAATCCGTGANNNGATCGACATG | 7611 |
| TGCAGGACCAGAGAATTCGAATACATTACTGTTNNNGATCGACATG | 7372 | TGCAGGACCAGAGAATTCGAATACAGTAGCTGTNNNGATCGACATG | 7612 |
| TGCAGGACCAGAGAATTCGAATACAGGTTCCCCNNNGATCGACATG | 7373 | TGCAGGACCAGAGAATTCGAATACAGAAGACGTNNNGATCGACATG | 7613 |

FIG. 22F

| Pool-31 | SEQ ID NO: | Pool-32 | SEQ ID NO: |
|---|---|---|---|
| TGCAGGACCAGAGAATTCGAATACAATAAACCTNNNGATCGACATG | 7374 | TGCAGGACCAGAGAATTCGAATACATCCGTACTNNNGATCGACATG | 7614 |
| TGCAGGACCAGAGAATTCGAATACATTTCGTGCNNNGATCGACATG | 7375 | TGCAGGACCAGAGAATTCGAATACATGAGGCAANNNGATCGACATG | 7615 |
| TGCAGGACCAGAGAATTCGAATACAGTGACCATNNNGATCGACATG | 7376 | TGCAGGACCAGAGAATTCGAATACATGAGTTATNNNGATCGACATG | 7616 |
| TGCAGGACCAGAGAATTCGAATACACCCTATACNNNGATCGACATG | 7377 | TGCAGGACCAGAGAATTCGAATACAATTGGTGCNNNGATCGACATG | 7617 |
| TGCAGGACCAGAGAATTCGAATACACCCCATATNNNGATCGACATG | 7378 | TGCAGGACCAGAGAATTCGAATACAGGCGTTGCNNNGATCGACATG | 7618 |
| TGCAGGACCAGAGAATTCGAATACAGATAGGTGNNNGATCGACATG | 7379 | TGCAGGACCAGAGAATTCGAATACAGCATCTCTNNNGATCGACATG | 7619 |
| TGCAGGACCAGAGAATTCGAATACAAAATAACGNNNGATCGACATG | 7380 | TGCAGGACCAGAGAATTCGAATACAACTCTCCANNNGATCGACATG | 7620 |
| TGCAGGACCAGAGAATTCGAATACAATAATCGTNNNGATCGACATG | 7381 | TGCAGGACCAGAGAATTCGAATACAATAAGTAGNNNGATCGACATG | 7621 |
| TGCAGGACCAGAGAATTCGAATACAGTGGACTTNNNGATCGACATG | 7382 | TGCAGGACCAGAGAATTCGAATACAGATTGCCANNNGATCGACATG | 7622 |
| TGCAGGACCAGAGAATTCGAATACAGTTACTGGNNNGATCGACATG | 7383 | TGCAGGACCAGAGAATTCGAATACAGTTCCAGANNNGATCGACATG | 7623 |
| TGCAGGACCAGAGAATTCGAATACATCCTAGGANNNGATCGACATG | 7384 | TGCAGGACCAGAGAATTCGAATACAAACCGTACNNNGATCGACATG | 7624 |
| TGCAGGACCAGAGAATTCGAATACAAAACTTACNNNGATCGACATG | 7385 | TGCAGGACCAGAGAATTCGAATACACGCGTTGGNNNGATCGACATG | 7625 |
| TGCAGGACCAGAGAATTCGAATACAAAGTGCTCNNNGATCGACATG | 7386 | TGCAGGACCAGAGAATTCGAATACAAATTCCAANNNGATCGACATG | 7626 |
| TGCAGGACCAGAGAATTCGAATACAGTATTTTCNNNGATCGACATG | 7387 | TGCAGGACCAGAGAATTCGAATACATGACAGTNNNGATCGACATG | 7627 |
| TGCAGGACCAGAGAATTCGAATACAGAAAGCTGNNNGATCGACATG | 7388 | TGCAGGACCAGAGAATTCGAATACAATGGATTTNNNGATCGACATG | 7628 |
| TGCAGGACCAGAGAATTCGAATACAATCACGACNNNTGCATCAGGT | 7389 | TGCAGGACCAGAGAATTCGAATACAAAGTCCACNNNTGCATCAGGT | 7629 |
| TGCAGGACCAGAGAATTCGAATACAAGGACCTTNNNTGCATCAGGT | 7390 | TGCAGGACCAGAGAATTCGAATACAGTGGCGCTNNNTGCATCAGGT | 7630 |
| TGCAGGACCAGAGAATTCGAATACAGAATGTAANNNTGCATCAGGT | 7391 | TGCAGGACCAGAGAATTCGAATACATCTGGATGNNNTGCATCAGGT | 7631 |
| TGCAGGACCAGAGAATTCGAATACAAAACTGCCNNNTGCATCAGGT | 7392 | TGCAGGACCAGAGAATTCGAATACACCGATGCGNNNTGCATCAGGT | 7632 |
| TGCAGGACCAGAGAATTCGAATACAATACAATCNNNTGCATCAGGT | 7393 | TGCAGGACCAGAGAATTCGAATACAAGTGCTCANNNTGCATCAGGT | 7633 |
| TGCAGGACCAGAGAATTCGAATACAGAGCAGCGNNNTGCATCAGGT | 7394 | TGCAGGACCAGAGAATTCGAATACACAATAGTTNNNTGCATCAGGT | 7634 |
| TGCAGGACCAGAGAATTCGAATACATCGTGTTCNNNTGCATCAGGT | 7395 | TGCAGGACCAGAGAATTCGAATACATACAGGCTNNNTGCATCAGGT | 7635 |
| TGCAGGACCAGAGAATTCGAATACACTGAGCCGNNNTGCATCAGGT | 7396 | TGCAGGACCAGAGAATTCGAATACATATACCTTNNNTGCATCAGGT | 7636 |
| TGCAGGACCAGAGAATTCGAATACACAAGCAGANNNTGCATCAGGT | 7397 | TGCAGGACCAGAGAATTCGAATACAGGAGTAACNNNTGCATCAGGT | 7637 |
| TGCAGGACCAGAGAATTCGAATACAGTCTTACCNNNTGCATCAGGT | 7398 | TGCAGGACCAGAGAATTCGAATACAGCTATGACNNNTGCATCAGGT | 7638 |
| TGCAGGACCAGAGAATTCGAATACACGTCTCCGNNNTGCATCAGGT | 7399 | TGCAGGACCAGAGAATTCGAATACAGTTACACGNNNTGCATCAGGT | 7639 |
| TGCAGGACCAGAGAATTCGAATACAGGCGTTCGNNNTGCATCAGGT | 7400 | TGCAGGACCAGAGAATTCGAATACAGAAGGAAGNNNTGCATCAGGT | 7640 |
| TGCAGGACCAGAGAATTCGAATACACCGCACCTNNNTGCATCAGGT | 7401 | TGCAGGACCAGAGAATTCGAATACAATGACTTANNNTGCATCAGGT | 7641 |
| TGCAGGACCAGAGAATTCGAATACAAGTGGTTCNNNTGCATCAGGT | 7402 | TGCAGGACCAGAGAATTCGAATACATCTCTAATNNNTGCATCAGGT | 7642 |
| TGCAGGACCAGAGAATTCGAATACAGTTGCGTANNNTGCATCAGGT | 7403 | TGCAGGACCAGAGAATTCGAATACAGGAATAATNNNTGCATCAGGT | 7643 |
| TGCAGGACCAGAGAATTCGAATACACCAAATGCNNNTGCATCAGGT | 7404 | TGCAGGACCAGAGAATTCGAATACAATTATACGNNNTGCATCAGGT | 7644 |
| TGCAGGACCAGAGAATTCGAATACAGCTTTGTCNNNTGCATCAGGT | 7405 | TGCAGGACCAGAGAATTCGAATACACAAAGGACNNNTGCATCAGGT | 7645 |
| TGCAGGACCAGAGAATTCGAATACACTTCAATTNNNTGCATCAGGT | 7406 | TGCAGGACCAGAGAATTCGAATACAATAGAATGNNNTGCATCAGGT | 7646 |

FIG. 22G

| Pool-31 | SEQ ID NO: | Pool-32 | SEQ ID NO: |
|---|---|---|---|
| TGCAGGACCAGAGAATTCGAATACAGAATCTGCNNNTGCATCAGGT | 7407 | TGCAGGACCAGAGAATTCGAATACAGGTCTGCGNNNTGCATCAGGT | 7647 |
| TGCAGGACCAGAGAATTCGAATACACCAGGACCNNNTGCATCAGGT | 7408 | TGCAGGACCAGAGAATTCGAATACACATTTTCANNNTGCATCAGGT | 7648 |
| TGCAGGACCAGAGAATTCGAATACAAGAGCATGNNNTGCATCAGGT | 7409 | TGCAGGACCAGAGAATTCGAATACAGCAGAGGCNNNTGCATCAGGT | 7649 |
| TGCAGGACCAGAGAATTCGAATACAACGGCCACNNNTGCATCAGGT | 7410 | TGCAGGACCAGAGAATTCGAATACAGCGGTAGGNNNTGCATCAGGT | 7650 |
| TGCAGGACCAGAGAATTCGAATACACCTAAACGNNNTGCATCAGGT | 7411 | TGCAGGACCAGAGAATTCGAATACAGGAGTCGGNNNTGCATCAGGT | 7651 |
| TGCAGGACCAGAGAATTCGAATACAGGTAACTCNNNTGCATCAGGT | 7412 | TGCAGGACCAGAGAATTCGAATACAACCATTCCNNNTGCATCAGGT | 7652 |
| TGCAGGACCAGAGAATTCGAATACATGGCTGATNNNTGCATCAGGT | 7413 | TGCAGGACCAGAGAATTCGAATACATCAAATGTNNNTGCATCAGGT | 7653 |
| TGCAGGACCAGAGAATTCGAATACAGCCGTAGCNNNTGCATCAGGT | 7414 | TGCAGGACCAGAGAATTCGAATACACAGTTCGANNNTGCATCAGGT | 7654 |
| TGCAGGACCAGAGAATTCGAATACATATCATTCNNNTGCATCAGGT | 7415 | TGCAGGACCAGAGAATTCGAATACAGATCTAATNNNTGCATCAGGT | 7655 |
| TGCAGGACCAGAGAATTCGAATACAGAGCAGTANNNTGCATCAGGT | 7416 | TGCAGGACCAGAGAATTCGAATACATTTCAGTNNNTGCATCAGGT | 7656 |
| TGCAGGACCAGAGAATTCGAATACAGCGTAAGANNNTGCATCAGGT | 7417 | TGCAGGACCAGAGAATTCGAATACAGACAATTTNNNTGCATCAGGT | 7657 |
| TGCAGGACCAGAGAATTCGAATACATCGCAAACNNNTGCATCAGGT | 7418 | TGCAGGACCAGAGAATTCGAATACAGCCGTAATNNNTGCATCAGGT | 7658 |
| TGCAGGACCAGAGAATTCGAATACAGAAGCTTCNNNTGCATCAGGT | 7419 | TGCAGGACCAGAGAATTCGAATACAAATACAAGNNNTGCATCAGGT | 7659 |
| TGCAGGACCAGAGAATTCGAATACATATTACCTNNNTGCATCAGGT | 7420 | TGCAGGACCAGAGAATTCGAATACAGTCCGCGANNNTGCATCAGGT | 7660 |
| TGCAGGACCAGAGAATTCGAATACATGCATGTGNNNTGCATCAGGT | 7421 | TGCAGGACCAGAGAATTCGAATACACCATCATCNNNTGCATCAGGT | 7661 |
| TGCAGGACCAGAGAATTCGAATACAGCTTTGAGNNNTGCATCAGGT | 7422 | TGCAGGACCAGAGAATTCGAATACACCTGTCATNNNTGCATCAGGT | 7662 |
| TGCAGGACCAGAGAATTCGAATACATCCTATTANNNTGCATCAGGT | 7423 | TGCAGGACCAGAGAATTCGAATACAGCTTCCTANNNTGCATCAGGT | 7663 |
| TGCAGGACCAGAGAATTCGAATACACGTCAGGCNNNTGCATCAGGT | 7424 | TGCAGGACCAGAGAATTCGAATACAACCCAACANNNTGCATCAGGT | 7664 |
| TGCAGGACCAGAGAATTCGAATACACCGCGATGNNNTGCATCAGGT | 7425 | TGCAGGACCAGAGAATTCGAATACAAAACGCGANNNTGCATCAGGT | 7665 |
| TGCAGGACCAGAGAATTCGAATACAGGTTGTCANNNTGCATCAGGT | 7426 | TGCAGGACCAGAGAATTCGAATACATCTGCATCNNNTGCATCAGGT | 7666 |
| TGCAGGACCAGAGAATTCGAATACAGCAGCAAANNNTGCATCAGGT | 7427 | TGCAGGACCAGAGAATTCGAATACAATTCCAAANNNTGCATCAGGT | 7667 |
| TGCAGGACCAGAGAATTCGAATACAGCGTAACTNNNTGCATCAGGT | 7428 | TGCAGGACCAGAGAATTCGAATACACACCAAGTNNNTGCATCAGGT | 7668 |
| TGCAGGACCAGAGAATTCGAATACAGAGAGTCANNNTGCATCAGGT | 7429 | TGCAGGACCAGAGAATTCGAATACAGCACAACTNNNTGCATCAGGT | 7669 |
| TGCAGGACCAGAGAATTCGAATACACTATGCCTNNNTGCATCAGGT | 7430 | TGCAGGACCAGAGAATTCGAATACAAGGTGGATNNNTGCATCAGGT | 7670 |
| TGCAGGACCAGAGAATTCGAATACAAACCGAAGNNNTGCATCAGGT | 7431 | TGCAGGACCAGAGAATTCGAATACATGCTAGCANNNTGCATCAGGT | 7671 |
| TGCAGGACCAGAGAATTCGAATACACGGCCCGGNNNTGCATCAGGT | 7432 | TGCAGGACCAGAGAATTCGAATACATTGTGAGCNNNTGCATCAGGT | 7672 |
| TGCAGGACCAGAGAATTCGAATACAAAGCGCCCNNNTGCATCAGGT | 7433 | TGCAGGACCAGAGAATTCGAATACAAGTTTCGGNNNTGCATCAGGT | 7673 |
| TGCAGGACCAGAGAATTCGAATACAATAAGGATNNNTGCATCAGGT | 7434 | TGCAGGACCAGAGAATTCGAATACAGCTAGTACNNNTGCATCAGGT | 7674 |
| TGCAGGACCAGAGAATTCGAATACAAGCTGAGANNNTGCATCAGGT | 7435 | TGCAGGACCAGAGAATTCGAATACATAGGTGCTNNNTGCATCAGGT | 7675 |
| TGCAGGACCAGAGAATTCGAATACACTCTGACTNNNTGCATCAGGT | 7436 | TGCAGGACCAGAGAATTCGAATACACATTACGGNNNTGCATCAGGT | 7676 |
| TGCAGGACCAGAGAATTCGAATACATCGCAGGCNNNTGCATCAGGT | 7437 | TGCAGGACCAGAGAATTCGAATACATGCAATTANNNTGCATCAGGT | 7677 |
| TGCAGGACCAGAGAATTCGAATACAATATTAGCNNNTGCATCAGGT | 7438 | TGCAGGACCAGAGAATTCGAATACATGGCCCTNNNTGCATCAGGT | 7678 |
| TGCAGGACCAGAGAATTCGAATACAACCGTATGNNNTGCATCAGGT | 7439 | TGCAGGACCAGAGAATTCGAATACAGCTGCAGCNNNTGCATCAGGT | 7679 |

FIG. 22H

| Pool-31 | SEQ ID NO: | Pool-32 | SEQ ID NO: |
|---|---|---|---|
| TGCAGGACCAGAGAATTCGAATAC AGGTCGGTCNNNTGCATCAGGT | 7440 | TGCAGGACCAGAGAATTCGAATA CATTTGCCCANNNTGCATCAGGT | 7680 |
| TGCAGGACCAGAGAATTCGAATAC AATATCGTANNNTGCATCAGGT | 7441 | TGCAGGACCAGAGAATTCGAATA CAGACCATTGNNNTGCATCAGGT | 7681 |
| TGCAGGACCAGAGAATTCGAATAC AACCTCTCANNNTGCATCAGGT | 7442 | TGCAGGACCAGAGAATTCGAATA CACCGCGTAGNNNTGCATCAGGT | 7682 |
| TGCAGGACCAGAGAATTCGAATAC AGTCGGTGCNNNTGCATCAGGT | 7443 | TGCAGGACCAGAGAATTCGAATA CATTAGCTGGNNNTGCATCAGGT | 7683 |
| TGCAGGACCAGAGAATTCGAATAC ATTCGCCCGNNNTGCATCAGGT | 7444 | TGCAGGACCAGAGAATTCGAATA CATCTGATTTNNNTGCATCAGGT | 7684 |
| TGCAGGACCAGAGAATTCGAATAC ACAGGCTGCNNNTGCATCAGGT | 7445 | TGCAGGACCAGAGAATTCGAATA CATCATAGGCNNNTGCATCAGGT | 7685 |
| TGCAGGACCAGAGAATTCGAATAC ATCGCTTACNNNTGCATCAGGT | 7446 | TGCAGGACCAGAGAATTCGAATA CATGGAGGTANNNTGCATCAGGT | 7686 |
| TGCAGGACCAGAGAATTCGAATAC ACGGATTGTNNNTGCATCAGGT | 7447 | TGCAGGACCAGAGAATTCGAATA CAGTCTCTACNNNTGCATCAGGT | 7687 |
| TGCAGGACCAGAGAATTCGAATAC ACAAGCTGTNNNTGCATCAGGT | 7448 | TGCAGGACCAGAGAATTCGAATA CAGCCTGGTGNNNTGCATCAGGT | 7688 |

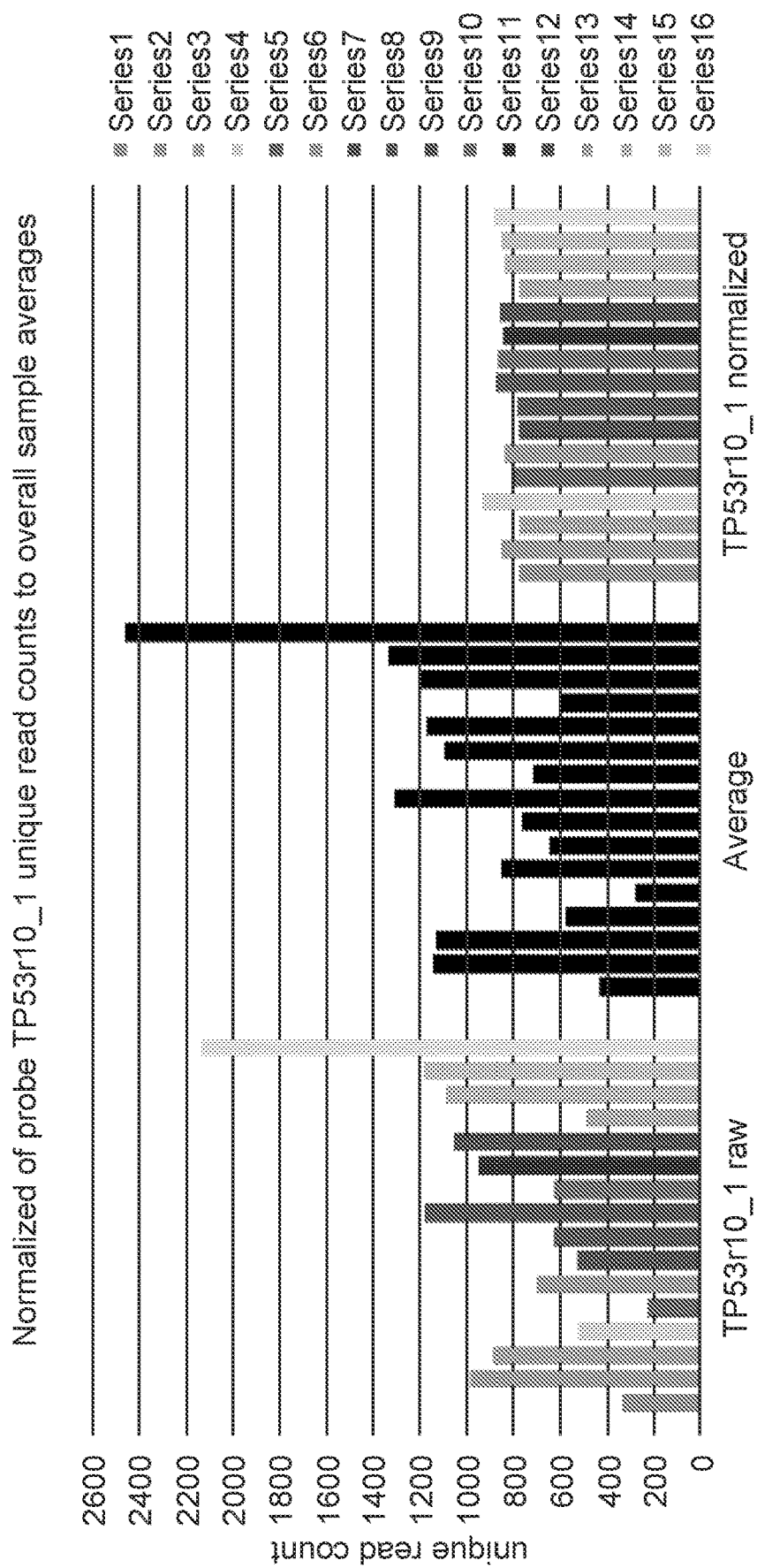

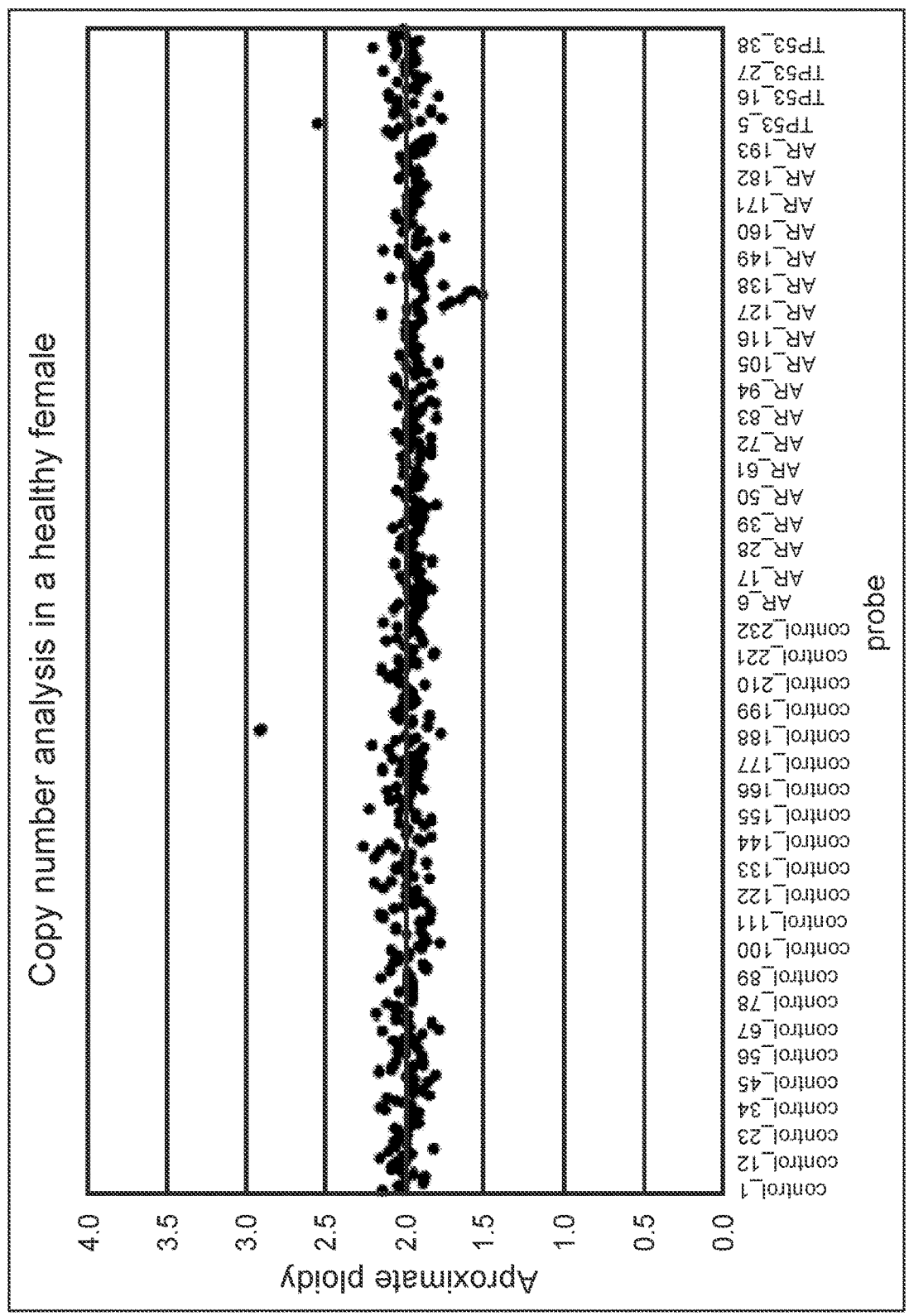

METHODS FOR THE DETECTION OF GENOMIC COPY CHANGES IN DNA SAMPLES

REFERENCE TO RELATED APPLICATIONS

This application claims priority to U.S. Provisional Patent Application No. 62/379,593, filed Aug. 25, 2016, and U.S. Provisional Patent Application No. 62/481,538, filed Apr. 4, 2017, each of which are incorporated herein by reference in their entireties.

STATEMENT REGARDING SEQUENCE LISTING

The sequence listing associated with this application is provided in text format in lieu of a paper copy, and is hereby incorporated by reference into the specification. The name of the text file containing the sequence listing is CLFK_005_02US_SeqList_ST25. The text file is 2,238 KB, was created on Aug. 24, 2017, and is being submitted electronically via EFS-Web.

TECHNICAL FIELD

The invention relates generally to compositions and methods for the quantitative genetic analysis of biological samples, e.g., direct tissue biopsies or peripheral blood. In particular, the present invention relates to methods for detection of target-specific copy number change, as well as genetic characterization and analysis, of biological samples.

BACKGROUND

It is becoming increasing clear that most, if not all, of the most common human cancers are diseases of the human genome. It is thought that somatic mutations accumulate during an individual's lifetime, some of which increase the probability that the cell in which they are harbored can develop into a tumor. With just the wrong combination of accumulated mutational events, a precancerous growth loses constraints that keep uncontrolled proliferation in check and the resulting cell mass becomes a cancer. The constellations of mutations that are necessary and sufficient to cause cancer are often collectively referred to as "driver mutations." One of the themes that have emerged from recent and intensive molecular analysis is that cancer, once thought of as a single, tissue-specific disease, is in fact a group of related diseases, each with a unique molecular pathology. The human genome project laid the groundwork for genome-wide analysis of cancers.

Changes in gene copy number are a fundamental driver of biological diversity. In the context of evolution, duplication of genes and divergence of function is a well-recognized driver of species diversity. In the context of human disease, gene loss and gene amplification within somatic cells are hallmarks of diseased tissues such as cancer. Certain therapeutic agents act specifically on cells with these genomic gain and/or loss mutations, however, the identification of these copy number variations is difficult because often such mutations are only present within the DNA of diseased or cancerous cells and are not found in other cells of the body. While the diseased tissue or cells is the major source of the mutated DNA, acquiring DNA through a biopsy is invasive, risky and often not possible. The observation that dying tumor or cancer cells release small pieces of their DNA into the bloodstream, termed cell free DNA or circulating DNA has allowed for the development of genetic tests that can be performed with less invasive techniques, such as a blood sample. However, only small amounts of DNA can be obtained from isolating cell free DNA from a sample, and only a portion of the total DNA will carry the mutation associated with the disease. For example, in the context of cancer genomics, diagnostically significant tumor mutations are often only found at minor allele frequencies that are significantly less than 50%. This is in contrast to conventional SNP genotyping where allele frequencies are generally ~100%, 50% or 0%.

Thus there is a need for genomic techniques capable of detecting genetic copy number changes in specific target loci.

BRIEF SUMMARY

Methods of detecting rare mutations in cfDNA have been previously described in International PCT Publication No. WO 2016/028316. However, these techniques still lack the requisite sensitivity to detect the rarest copy number losses at very minor allele frequencies. Provided herein are compositions and methods for detection of target-specific copy number change that are applicable to several sample types, including direct tissue biopsies, peripheral blood, and in particular cfDNA, The compositions and methods described herein are sensitive enough to detect changes in copy number that are present only a tiny fraction of the total DNA.

The present invention includes, inter alia, compositions and methods that are useful for the detection of a mutational change, SNP, translocation, inversion, deletion, change in copy number, or other genetic variation within a sample of cellular genomic DNA (e.g., from a tissue biopsy sample) or cfDNA (e.g., from a blood sample). In particular, the compositions and methods of the present invention provide an extremely high level of resolution that is particularly useful in detecting copy number variations in a small fraction of the total cfDNA from a biological sample (e.g., blood).

Particular embodiments are drawn to a method for performing a genetic analysis on a DNA target region from a test sample comprising: (a) generating a genomic DNA library comprising a plurality of DNA library fragments, wherein each of the DNA library fragments comprises a genomic DNA fragment from the test sample and an adaptor; (b) contacting the genomic DNA library with a plurality of capture probes that specifically bind to a DNA target region, thereby forming complexes between the capture probes and DNA library fragments comprising the DNA target region; and (c) performing a quantitative genetic analysis of the genomic DNA fragments comprising the DNA target region; wherein the adaptor is a DNA polynucleotide that comprises: an amplification region, a sample tag region, and an anchor region; wherein the amplification region comprises a polynucleotide sequence capable of serving as a primer recognition site for PCR amplification; wherein the sample tag comprises a polynucleotide sequence that encodes an identity of the unique library DNA fragment and encodes an identity of the test sample; wherein the anchor region comprises a polynucleotide sequence that encodes the identity of the test sample and wherein the anchor region is capable of attaching to the genomic DNA fragment; and wherein the genetic analysis is performed to detect a genetic change indicative of a disease state.

In some embodiments, the genetic change indicative of a disease state is selected from a single nucleotide variant (SNV), an insertion less than 40 nucleotides in length, a deletion of a DNA region less than 40 nucleotides in length, and/or a change in copy number. In particular embodiments, the genetic change indicative of a disease state is a change in copy number. In some embodiments, the test sample is a tissue biopsy. In various embodiments, the tissue biopsy is taken from a tumor or a tissue suspected of being a tumor. In certain embodiments, the genomic DNA is cell free DNA (cfDNA) or cellular DNA. In particular embodiments, the genomic DNA is cfDNA is isolated from the test sample; and wherein the test sample is a biological sample selected from the group consisting of: amniotic fluid, blood, plasma, serum, semen, lymphatic fluid, cerebral spinal fluid, ocular fluid, urine, saliva, stool, mucous, and sweat.

In certain embodiments, the genomic DNA fragments are obtained the steps comprising; (i) isolating cellular DNA from the test sample; and (ii) fragmenting the cellular DNA to obtain the genomic DNA fragments. In particular embodiments, step (ii) is performed by contacting the cellular DNA with at least one digestion enzyme. In some embodiments, step (ii) is performed by applying mechanical stress to the cellular DNA. In certain embodiments, the mechanical stress is applied by sonicating the cellular DNA.

In particular embodiments, the sample tag further comprises a unique molecule identifier (UMI) that facilitates the identification of the unique genomic DNA fragment.

In some embodiments, the amplification region is between 10 and 50 nucleotides in length. In particular embodiments, the amplification region is between 20 and 30 nucleotides in length. In certain embodiments, the amplification region is 25 nucleotides in length.

In some embodiments, the sample tag is between 5 and 50 nucleotides in length. In particular embodiments, the sample tag is between 5 and 15 nucleotides in length. In certain embodiments, the sample tag is 8 nucleotides in length. In some embodiments, the UMI multiplier is adjacent to or contained within the sample tag region.

In certain embodiments, the UMI multiplier is between 1 and 5 nucleotides in length. In particular embodiments, the UMI multiplier is 3 nucleotides in length, and comprises one of 64 possible nucleotide sequences.

In some embodiments, the anchor region is between 1 and 50 nucleotides in length. In particular embodiments, the anchor region is between 5 and 25 nucleotides in length. In certain embodiments, the anchor region is 10 nucleotides in length.

Particular embodiments of the present invention are drawn to methods where the step of (a) generating a genomic DNA library comprising a plurality of DNA library fragments, comprises attaching the genomic DNA fragments to a plurality of adaptors. In certain embodiments, the genomic DNA fragments are end repaired prior to attaching the genomic DNA fragments with a plurality of adaptors. In particular embodiments, the amplification regions of each adaptor of the plurality of adaptors comprises an identical nucleotide sequence.

In certain embodiments, the sample tag region of each adaptor of the plurality of adaptors comprise one of between 2 and 1,000 nucleotide sequences. In particular embodiments, the sample tag region of each adaptor of the plurality of adaptors comprise one of between 50 and 500 nucleotide sequences. In various embodiments, the sample tag region of each adaptor of the plurality of adaptors comprises one of between 100 and 400 nucleotide sequences. In some embodiments, the sample tag region of each adaptor of the plurality of adaptors comprises one of between 200 and 300 nucleotide sequences. In certain embodiments, the sample tag region of each adaptor of the plurality of adaptors is 8 nucleotides in length. In some embodiments, each sequence of the nucleotide sequences are discrete from any other sequence of the 240 nucleotide sequences by Hamming distance of at least two.

In particular embodiments, each of the plurality of adaptors comprises a UMI multiplier that is adjacent to or contained within the sample tag region. In some embodiments, each of the plurality of adaptors comprises a UMI multiplier that is adjacent to the sample tag region. In certain embodiments, the UMI multiplier of each adaptor of the plurality of adaptors is between 1 and 5 nucleotides in length. In some embodiments, the UMI multiplier of each adaptor of the plurality of adaptors is three nucleotides in length.

In particular embodiments, the anchor tag region of each adaptor of the plurality of adaptors comprises one of four nucleotide sequences, and each sample region of a given sequence is paired to only one of the four anchor regions of a given sequence.

In some embodiments, the amplification regions of each adaptor of the plurality of adaptors comprises an identical nucleotide sequence; the sample tag region of each adaptor of the plurality of adaptors is 8 nucleotides in length; the nucleotide sequence of each sample tag is discrete from any other nucleotide sequence of the sample tags of the plurality of adaptors by Hamming distance of at least two; each of the plurality of adaptors comprises a UMI multiplier that is adjacent to or contained within the sample tag region; the UMI multiplier of each adaptor of the plurality of adaptors is three nucleotides in length; and the UMI multiplier of each of the possible nucleotide sequences is paired to each sample tag region of the plurality of adaptors; the anchor tag region of each adaptor of the plurality of adaptors comprises one of four nucleotide sequences: and each sample region of a given sequence is paired to only one of the four anchor regions of a given sequence.

Particular embodiments of the present invention are drawn to a method where the step of attaching the genomic DNA fragments with a plurality of adaptors comprises: (i) attaching an oligonucleotide comprising least a portion of an anchor region to each genomic DNA fragment, wherein the oligonucleotide comprising least a portion of an anchor region is a DNA duplex comprising a 5' phosphorylated attachment strand duplexed with a partner strand, wherein the partner strand is blocked from attachment by chemical modification at its 3' end, and wherein the attachment strand is attached to the genomic DNA fragment; (ii) contacting the genomic DNA fragments attached to the oligonucleotides comprising at least a portion of the anchor region with DNA oligonucleotides encoding full length adaptor sequences for each adaptor nucleotide sequence of the plurality of adaptors; and (iii) contacting the genomic DNA fragments and the DNA oligonucleotides encoding the full length adaptor sequence with T4 polynucleotide kinase, Taq DNA ligase and full-length Bst polymerase under conditions suitable for DNA ligation; thereby attaching the plurality of adaptors to the genomic DNA fragments. In some embodiments, the genomic DNA fragments are cfDNA. In certain embodiments, the DNA target region is analyzed for a change in copy number.

In particular embodiments, step (c) performing a quantitative genetic analysis of the genomic DNA fragments comprising the DNA target region comprises purification of the complexes formed between the capture probes and DNA library fragments comprising the DNA target region. In certain embodiments, step (c) comprises purification of the complexes formed between the capture probes and DNA library fragments comprising the DNA target region, preforming primer extension and/or amplification of the DNA library fragments comprising the region of interest from the genomic DNA library. In some embodiments, step (c) comprises purification of the complexes formed between the capture probes and DNA library fragments comprising the DNA target region, preforming primer extension and amplification of the DNA library fragments comprising the region of interest from the genomic DNA library. In certain embodiments, step (c) comprises DNA sequencing of the DNA library fragments comprising the DNA target region to generate a plurality of sequencing reads.

In some embodiments, the present invention is drawn to a method wherein the genomic analysis comprises determining a change of copy number in a DNA region of interest, and wherein step (c), performing a quantitative genetic analysis of the genomic DNA fragments comprising the DNA target region, comprises determining a copy number of the region of interest present in the genomic DNA library derived from the test sample, and comparing it to a copy number of the region of interest present in the genomic DNA library derived from a reference sample, wherein the reference sample comprises a known copy number of the DNA target region.

In some embodiments, determining the copy number in the region of interest comprises DNA sequencing of the DNA library fragments comprising the DNA target region to generate a plurality of sequencing reads, wherein each sequencing read comprises a unique molecular identification element (UMIE). In some embodiments, the UMIE comprises sequencing information from the adaptor and at least a portion of the genomic DNA sequence. In some embodiments, sequencing reads comprising identical UMIEs are identified as a unique genomic sequence (UGS).

In some embodiments, methods of determining the copy number further comprise determining a raw genomic depth (RGD) for each of the capture probes contacted with the genomic DNA library. In some embodiments, determining the RGD comprises determining the average number of UGSs associated with each capture probe sequence within a group of sample replicates. In some embodiments, capture probes associated with a highly variable number of UGSs are identified as noisy probes and are removed from further calculations. In some embodiments, determining the RGD further comprises calculating an RGD for a sample, comprising calculating a numerical average of all RGDs for all capture probes in the sample. In some embodiments, the RGD values for noisy probes are not included in calculating an RGD for a sample.

In some embodiments, the RGDs for the capture probes are normalized across all samples in an experimental group by converting the RGD for each capture probe into a probe-specific, normalized read count comprising (i) multiplying each capture probe RGD in a sample by a normalization constant, wherein the normalization constant comprises any real number; and (ii) dividing the product of (i) by the RGD calculated for the corresponding sample; or (iii) dividing the product of (i) by an average RGD calculated from a subset of probes. In some embodiments, the subset of probes is a set of control probes.

In some embodiments, the probe-specific, normalized read counts are converted in to a copy number value comprising (i) multiplying the probe-specific, normalized read counts of probes directed to autosomal and/or X-linked regions by 2 in samples derived from females; (ii) multiplying the probe-specific, normalized read counts of probes directed to Y-linked and/or X-linked regions by 1 in samples derived from males; (iii) averaging the products of (i) and/or (ii) across all samples in an experiment; and (iv) dividing the product of (i) and/or (ii) by the average of (iii). In some embodiments, the approximate copy number values for all probes that target a specific gene are averaged.

In some embodiments, the present invention is drawn to a method for highly sensitive detection of copy number gain and copy number loss comprising (i) determining an RGD for a capture probe; (ii) normalizing the RGD for the capture probe across all samples in an experimental group by converting the RGD for the capture probe into a probe-specific, normalized read count; (iii) calculating an approximate copy number value for each probe-specific, normalized read count; and (iv) averaging the approximate copy number values for all probes that target a specific gene.

In some embodiments, the present invention is drawn to a method for measuring chromosome stability comprising (i) designing and validating a set of one or more chromosomal stability probes, wherein the chromosomal stability probes are uniformly distributed across human chromosomes; (ii) performing targeted sequencing on patient samples using the one or more chromosomal stability probes; (iii) determining an approximate copy number value for each chromosomal probe; (iv) determining a genomic phenotype of a patient sample, wherein fluctuations in the copy number values for one or more chromosomal probes in the patient sample indicate genomic instability.

In some embodiments, the present invention is drawn to a method of treating a cancer in a subject in need thereof, wherein the subject has been identified as having a destabilized genome according to the method claim 62, wherein the method of treating the cancer comprises administering a pharmaceutically effective amount of a PARP inhibitor.

In some embodiments, the present invention is drawn to a method wherein the genomic analysis comprises determining a change of copy number in a DNA region of interest, and wherein step (c), performing a quantitative genetic analysis of the genomic DNA fragments comprising the DNA target region, comprises determining a copy number of the region of interest present in the genomic DNA library derived from the test sample, and comparing it to a copy number of the region of interest present in the genomic DNA library derived from a reference sample, wherein the reference sample comprises a known copy number of the DNA target region. In some embodiments, the region of interest is a gene or a portion of the gene. In particular embodiments, the gene is associated with a disease. In certain embodiments, the disease is a cancer. In various embodiments, the gene is BRCA2, ATM, BRCA1, BRIP1, CHEK2, FANCA, HDAC2, and/or PALB2.

Particular embodiments are drawn to a genomic DNA library comprising a plurality of DNA library fragments, wherein each of the DNA library fragments comprises an adaptor and a genomic DNA fragment; wherein the adaptor is a DNA polynucleotide that comprises: an amplification region, a sample tag region, and an anchor region; wherein the amplification region comprises a polynucleotide sequence capable of serving as a primer recognition site for PCR amplification; wherein the sample tag comprises a polynucleotide sequence that encodes an identity of the unique library DNA fragment and encodes an identity of the test sample; and wherein the anchor region comprises a polynucleotide sequence that encodes the identity of the test sample, and wherein the anchor region is capable of attaching to the genomic DNA fragment. In some embodiments, the sample tag further comprises a unique molecule identifier (UMI), wherein the UMI facilitates the identification of the unique genomic DNA fragment. In particular embodiments, the amplification region is between 10 and 50 nucleotides in length. In particular embodiments, the amplification region is 25 nucleotides in length. In particular embodiments, the sample tag is between 5 and 50 nucleotides in length. In certain embodiments, the sample tag is 8 nucleotides in length. In some embodiments, the UMI multiplier is adjacent to or contained within the sample tag region. In particular embodiments, the UMI multiplier is between 1 and 5 nucleotides in length. In certain embodiments, the anchor region is between 1 and 50 nucleotides in length. In some embodiments, the anchor region is 10 nucleotides in length. In particular embodiments, the amplification regions of each adaptor of the plurality of adaptors comprises an identical nucleotide sequence. In some embodiments, each nucleotide sequence of the sample tags are discrete from any other sequence of the nucleotide sequences of the sample by Hamming distance of at least two. In certain embodiments, each of the plurality of adaptors comprises a UMI multiplier that is adjacent to or contained within the sample tag region. In particular embodiments, each of the plurality of adaptors comprises a UMI multiplier that is adjacent to the sample tag region. In some embodiments, the anchor tag region of each adaptor of the plurality of adaptors comprises one of four nucleotide sequences, and wherein each sample region of a given sequence is paired to only one of the four anchor regions of a given sequence. In some embodiments, the genomic DNA fragment is cfDNA.

In certain embodiments, the amplification regions of each adaptor of the plurality of adaptors comprises an identical nucleotide sequence; the sample tag region of each adaptor of the plurality of adaptors is 8 nucleotides in length, the sample tag region of each adaptor of the plurality of adaptors comprises a nucleotide sequence that is discrete from any other nucleotide sequence of the sample tags of the plurality of adaptors by Hamming distance of at least two, the each of the plurality of adaptors comprises a UMI multiplier that is adjacent to or contained within the sample tag region, the UMI multiplier of each adaptor of the plurality of adaptors is three nucleotides in length, and the UMI multiplier of each of the possible nucleotide sequences is paired to each of the sample tag regions of the plurality of adaptors, the anchor tag region of each adaptor of the plurality of adaptors comprises one of four nucleotide sequences, and each sample region of a given sequence is paired to only one of the four anchor regions of a given sequence. In some embodiments, the genomic DNA fragment is cfDNA.

Certain embodiments are drawn to a plurality of genomic DNA libraries, comprising more than one genomic library described herein. In some embodiments, the nucleic acid sequences of the sample tag regions of a genomic DNA library belonging to the plurality of genomic DNA libraries are different from the nucleic acid sequences of the sample tag regions of other genomic DNA libraries belonging to the plurality of genomic DNA libraries. In particular embodiments, the nucleic acid sequences of the amplification regions of a genomic DNA library belonging to the plurality of genomic DNA libraries are identical to the nucleic acid sequences of the amplification regions of other genomic DNA libraries belonging to the plurality of genomic DNA libraries.

Certain embodiments are drawn to a method for genetic analysis of a DNA target region of cell free DNA (cfDNA) comprising: (a) generating a DNA library as described herein; (b) contacting the cfDNA library with a plurality of capture probes that specifically bind to a DNA target region, thereby forming complexes between the capture probes and DNA library fragments comprising the DNA target region; and (c) performing a quantitative genetic analysis of the cfDNA fragments comprising the DNA target region; thereby performing genetic analysis of the DNA target region.

Certain embodiments are directed to a method of predicting, diagnosing, or monitoring a genetic disease in a subject comprising: (a) obtaining a test sample from the subject; (b) isolating genomic DNA from the test sample; (c) generating a DNA library comprising a plurality of DNA library fragments, wherein each of the DNA library fragments comprises a genomic DNA fragment from the test sample and an adaptor; (d) contacting the cfDNA library with a plurality of capture probes that specifically bind to a DNA target region, thereby forming complexes between the capture probes and DNA library fragments comprising the DNA target region; and (e) performing a quantitative genetic analysis of one or more target genetic loci associated with the genetic disease in the cfDNA clone library, wherein the identification or detection of one or more genetic lesions in the one or more target genetic loci is prognostic for, diagnostic of, or monitors the progression of the genetic disease. In particular embodiments, the quantitative genetic analysis comprises DNA sequencing to generate a plurality of sequencing reads.

Particular embodiments are drawn to a set of adaptors that encode an identify of a unique genomic DNA fragment and an identity of a test sample, for use in generating a genomic DNA library, wherein each adaptor in said set of adapters is a DNA polynucleotide that comprises: an amplification region, a sample tag region, and an anchor region; wherein the amplification region comprises a polynucleotide sequence capable of serving as a primer recognition site for PCR amplification; wherein the sample tag comprises a polynucleotide sequence that encodes the identity of the unique library DNA fragment and encodes the identity of the test sample; and wherein the anchor region comprises a polynucleotide sequence that encodes the identity of the test sample, and wherein the anchor region is capable of attaching to the genomic DNA fragment. In some embodiments, the sample tag further comprises a unique molecule identifier (UMI), wherein the UMI facilitates the identification of the unique genomic DNA fragment. In various embodiments, the amplification region is between 10 and 50 nucleotides in length. In certain embodiments, the amplification region is 25 nucleotides in length. In particular embodiments, the sample tag is between 5 and 50 nucleotides in length. In some embodiments, the sample tag is 8 nucleotides in length. In particular embodiments, the UMI multiplier is adjacent to or contained within the sample tag region. In some embodiments, the UMI multiplier is between 1 and 5 nucleotides in length. In particular embodiments, the anchor region is between 1 and 50 nucleotides in length. In some embodiments, the anchor region is 10 nucleotides in length. In certain embodiments, the amplification regions of each adaptor of the plurality of adaptors comprises an identical nucleotide sequence.

In some embodiments, each nucleotide sequence of the sample tags is discrete from any other nucleotide sequence of the sample tags of the set of adaptors by Hamming distance of at least two. In various embodiments, each of the plurality of adaptors comprises a UMI multiplier that is adjacent to or contained within the sample tag region. In particular embodiments, each of the plurality of adaptors comprises a UMI multiplier that is adjacent to the sample tag region.

In some embodiments, the anchor tag region of each adaptor of the plurality of adaptors comprises one of four nucleotide sequences, and wherein each sample region of a given sequence is paired to only one of the four anchor regions of a given sequence. The set of adaptors claim 75, wherein the amplification regions of each adaptor of the plurality of adaptors comprises an identical nucleotide sequence; wherein the sample tag region of each adaptor is 8 nucleotides in length, wherein each nucleotide sequence of the sample tags is discrete from any other nucleotide sequence of the sample tags of the set of adaptors by Hamming distance of at least two, wherein each of the plurality of adaptors comprises a UMI multiplier that is adjacent to or contained within the sample tag region, wherein the UMI multiplier of each adaptor of the plurality of adaptors is three nucleotides in length, wherein the UMI multiplier comprises one of 64 possible nucleotide sequences, and wherein the UMI multiplier of each of the 64 possible nucleotide sequences is paired to each of the sample tag region of the plurality of adaptors, wherein the anchor tag region of each adaptor of the plurality of adaptors comprises one of four nucleotide sequences, and wherein each sample region of a given sequence is paired to only one of the four anchor regions of a given sequence.

BRIEF DESCRIPTION OF THE SEVERAL VIEWS OF THE DRAWINGS

FIG. 4A shows the first generation adaptor design. FIG. 4B shows that in the first generation adaptors, there were a collection of 249 possible sequence tags, each 5 nucleotides (nt) in length that attached to a single anchor sequence. FIG. 4C shows a diagram of a second generation adaptor. FIG. 4D shows an illustrative set of adaptors that are applied to a single sample that consists of four sets of 8 mer tag sequences with each set having 60 members. Each set of 60 tags is specific to one of four anchor sequences. FIG. 4E shows an illustrative DNA sequence of a 47 nt adaptor.

FIG. 6A shows the step where the 10 nt anchor sequence is attached to the 3' ends of genomic fragments. FIG. 6B shows the step where the full length genomic adaptors are annealed to the initial anchor sequence.

FIG. 8A-FIG. 8C shows conventional box-and-whiskers plots of measured gene copies across eight samples as determined by CNL analysis.

FIG. 11A shows conversion of cfDNA to a genomic library by the addition of adaptor sequences that provide universal, single-primer PCR amplification sequences, sample multiplexing tags, and unique molecular identifiers to every genomic clone. FIG. 11B shows denatured amplified genomic hybridized with target specific capture probes and primer extension. FIG. 11C shows a schematic of asymmetric paired-end sequencing. FIG. 11D shows mapping statistics for 377,711,020 Illumina NextSeq reads from a typical targeted capture sequence run. 98.5% of reads map to their intended targets. Following de-duplication, 20.40% of reads (77,053,048) are derived from unique genomic clones.

FIG. 12A-FIG. 12H shows sequences of adaptor oligonucleotides from Pools 1-3.

FIG. 13A-FIG. 13H shows sequences of adaptor oligonucleotides from Pools 4-6.

FIG. 14A-FIG. 14I shows sequences of adaptor oligonucleotides from Pools 7-9.

FIG. 15A-FIG. 15H shows sequences of adaptor oligonucleotides from Pools 10-12.

FIG. 16A-FIG. 16H shows sequences of adaptor oligonucleotides from Pools 13-15.

FIG. 17A-FIG. 17H shows sequences of adaptor oligonucleotides from Pools 16-18.

FIG. 18A-FIG. 18H shows sequences of adaptor oligonucleotides from Pools 19-21.

FIG. 19A-FIG. 19H shows sequences of adaptor oligonucleotides from Pools 22-24.

FIG. 20A-FIG. 20H shows sequences of adaptor oligonucleotides from Pools 25-27.

FIG. 21A-FIG. 21H shows sequences of adaptor oligonucleotides from Pools 28-30.

FIG. 22A-FIG. 22H shows sequences of adaptor oligonucleotides from Pools 31-32.

FIG. 23A illustrates BedFile display of capture probes. FIG. 23B illustrates coverage depth at each base position on a scale of 0 to 8000 unique reads. FIG. 23C illustrates a UCSC gene model display of known TP53 splice variants. The thicker rectangular regions represent the amino acid coding regions for the TP53-encoded protein.

FIG. 24A-FIG. 24C illustrate raw and normalized unique read density for a single probe, TP53r10_1, across 16 samples. FIG. 24A illustrates the number of raw unique reads capture by probe TP53r10_1 for 16 independent sample after removal of redundant reads by "de-duplication." FIG. 24B shows global average of unique reads across 2596 capture probes for all 16 samples. FIG. 24C shows normalized unique read depth across 16 samples (Calculated as: [sample n unique reads from probe TP53r10_1× constant÷global average unique reads/probe from sample n]).

FIG. 27A-FIG. 27C illustrate copy number analysis of cfDNA from a healthy female and male donor and from an advanced stage prostate cancer patient. FIG. 27A shows analysis of a cfDNA from a healthy female donor. The x-axis is a series of control probes that target regions from all 22 autosomal chromosomes, a series of probes that target the X-linked AR gene, and a series of probes that target the coding regions of the TP53 gene. The Y-axis shows the calculated ploidy for each probe. This approximation is calculated for each probe by normalizing the observed unique read counts to a series of control samples whose ploidy is known ([unique read count for probe_Y of sample_Z]×2÷[average unique read count for probe_Y for multiple control samples]). FIG. 27B illustrates that the X-linked AR gene exhibits a haploid copy number in healthy males. FIG. 27C illustrates copy number analysis of cfDNA from an advanced prostate cancer patient and shows evidence of very significant aneuploidy across the control probes, amplification of the AR gene, and loss of the TP53 gene.

DETAILED DESCRIPTION

A. Overview

Figure 1:
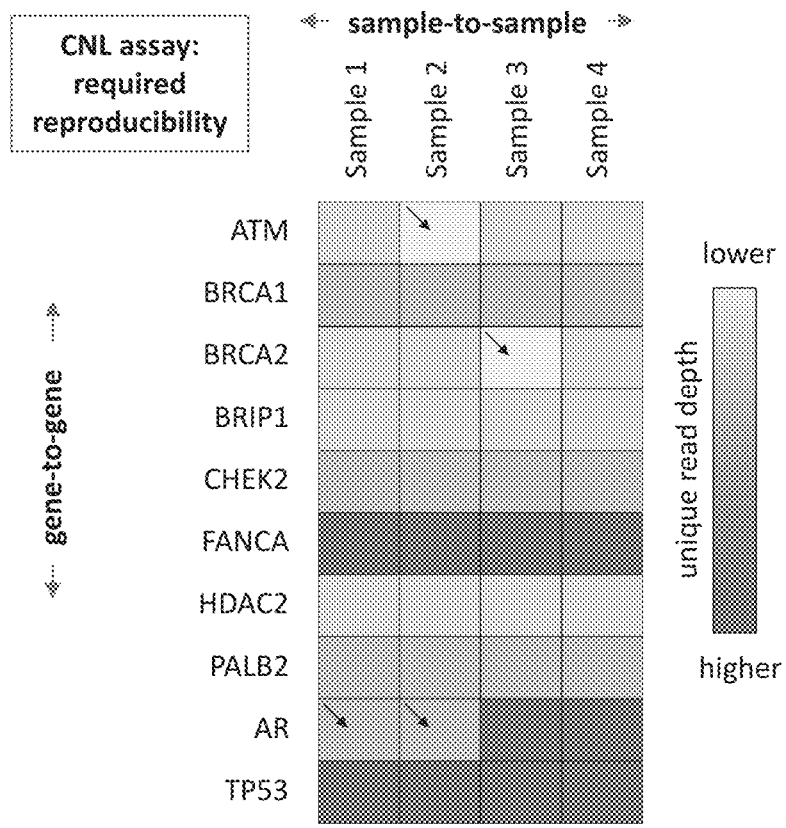
FIG. 1 shows the framework of the copy number loss (CNL) assay. Each gene (rows) exhibits a characteristic unique read value that is represented here by a shade. Each sample (columns) is interrogated across the same panel of genes.

The present invention includes, inter alia, compositions and methods that are useful for the detection of a mutational change, SNP, translocation, inversion, deletion, change in copy number or other genetic variation within a sample of cellular genomic DNA (e.g. from a tissue biopsy sample) or cfDNA (e.g. from a blood sample). The compositions and methods of the current invention are particularly useful in detecting incredibly hard to detect copy number variations in cfDNA from a biological sample (e.g. blood) with exquisite resolution. In particular, some embodiments of the present invention are drawn to a method for the detecting copy number of a DNA target region from a test sample by generating a genomic DNA library made up of genomic DNA fragments attached to an adaptor, capturing DNA target regions with a plurality of capture probes, isolating the DNA library fragments comprising the DNA target region, and performing a quantitative genetic analysis of the DNA target region to thereby determining the copy number of the DNA target region. The adaptors described herein allow for the identification of the individual DNA fragment that is being sequenced, as well as the identity of the sample or source of the genomic DNA.

The present invention contemplates, in part, compositions and methods for detection of target-specific copy number changes that are applicable to several sample types, including but not limited to direct tissue biopsies and peripheral blood. In the context of cancer genomics, and in particular cell free DNA (cfDNA) assays for the analysis of solid tumors, the amount of tumor DNA is often a very small fraction of the overall DNA. Further, copy number loss is difficult to detect in genomic DNA assays, and in particular, genomic DNA assays where copy number change may only be present in a portion of the total genomic DNA from a sample, e.g., cfDNA assays. For example, most of the cell-free DNA extracted from a cancer patient will be derived from normal sources and have a diploid copy number (except for X-linked genes in male subjects). In a cancer patient, the fraction of DNA derived from tumors often has a low minor allele frequency, such as for example, a patient in which 2% of the circulating DNA extracted from plasma is derived from the tumor. The loss of one copy of a tumor suppressor gene (for example, BRCA1 in breast cancer) means that the minor allele frequency for the absence of detectable genomic fragments is 1%. In this scenario, a copy number loss assay engineered must be able to discriminate between 100 copies (normal) and 99 copies (heterozygous gene loss). Thus, particular embodiments contemplate that the methods and compositions of the present invention allow for the detection of copy number change with sufficient resolution to detect changes in copy number at minor allele frequencies even in the context of cfDNA.

To achieve this level of discrimination, the present invention provides novel sample adaptor designs. The adaptors of the present invention are designed to include features that are critical for successful copy number loss assay performance including (i) even performance across adaptors; (ii) a high number of unique molecule identifiers (UMIs); (iii) high efficiency attachment; and (iv) accommodation of sample multiplexing. For example, the adaptors of the present invention provide the following:

Even performance across adaptors: Bioinformatics analysis often looks at intra-sample probe performance and inter-sample probe performance. Thus, it is contemplated that any performance fluctuation between adaptor pools across samples will negatively impact the ability to detect the subtle variations required by CNL analysis. In the present invention, this evenness of performance is achieved by having multiple anchor tags that are all represented in each sample tag pool, with the fixed sample tag regions (which serve to identify both the sample and the genomic fragments) being randomly selected for each pool, and a UMI multiplier that increases the unique sample tag sequences for identifying the genomic fragments.

High number of Unique Molecule Identifiers (UMIs): While adaptors must be functionally equivalent from a molecular biology perspective, they must possess a very large number of unique sequence tags (≥10,000) that augment the identification of unique genomic fragments. In this context, by "augment," it is meant that each genomic clone fragment has a particular pair of fragmentation sites corresponding to the position in the genomic sequence where the double-strand DNA was cleaved. This cleavage site is used to differentiate unique genomic clones since each clone is likely to possess a different cleavage site. However, in libraries that possess thousands of independent clones, uniquely derived fragments will often possess the exact same cleavage sites. Genomic clones (i.e. fragments) sharing the same cleavage site can be classified as either unique or as redundant with respect to other clone sequences derived from the same sample. By attaching adaptors that introduce a high diversity of sequence tags, different genomic clones sharing the same cleavage site are more likely to be identified as unique. In this system, the UMI is created by a combination of the sample tag region with the UMI multiplier. The combination of the UMI and the cleavage site create a unique molecular identifier element (UMIE), which facilitates the classification of sequence reads as redundant reads or unique reads. Particular embodiments contemplate that the UMI multiplier could comprise longer or shorter sequences to increase or lower the overall UMI complexity.

High efficiency attachment: Adaptors must attach to genomic fragments with high efficiency. In most oncology applications, the quantities of available cellular DNA or cfDNA are limited and therefore conversion of these genomic fragments to genomic library clones must be highly efficient. In order to achieve this, in some aspects of the present invention, the adaptor systems described herein convert about 25% to about 50% or greater of the genomic input fragments are converted into genomic library clones.

Accommodation of sample multiplexing: In general, there must be pools of different sets of adaptors where each unique adaptor of the set is attached to a different sample. At the same time, each member of the set of adaptors must possess essentially identical behavior (from a sequence counting perspective) to all other members in a set. In order to achieve this, in some embodiments, the sample tag regions have a Hamming distance of 2 between any other possible sample tag combinations reducing the chance for a read to be spuriously assigned to the wrong sample. In some embodiments, each set of adaptors is split into pools that are paired with specific anchor regions, allowing for further reduction in the possibility of an error in sample de-multiplexing. For example, in an 8 mer tag with Hamming distance of 2, the total number of possible sequences is 16,384.

In a particular embodiment, pre-specified pools of adaptor oligonucleotides are provided. Such pre-specified pools are used to represent a single sample. That is, each adapter sequence in each pool of X adapter oligonucleotides (16,384 in the example given above) is distinct from each adapter sequence in every other pool used to identify other samples. One of skill in the art will recognize the number of distinct pre-specified pools that are possible for the adapter oligonucleotides will depend on the length of the sample tag and/or the UMI multiplier.

Thus, in certain embodiments the adaptors comprise a sequence, i.e., the sample tag and adjacent and/or encompassed UMI multiplier that represents or identifies both the sample and uniquely identifies the genetic fragment. This is in stark contrast to the current systems that are used in the art that use a randomly generated tag to identify the sequence and a separate barcode or sequencer indexing to allow for multiplexing.

Figure 3:
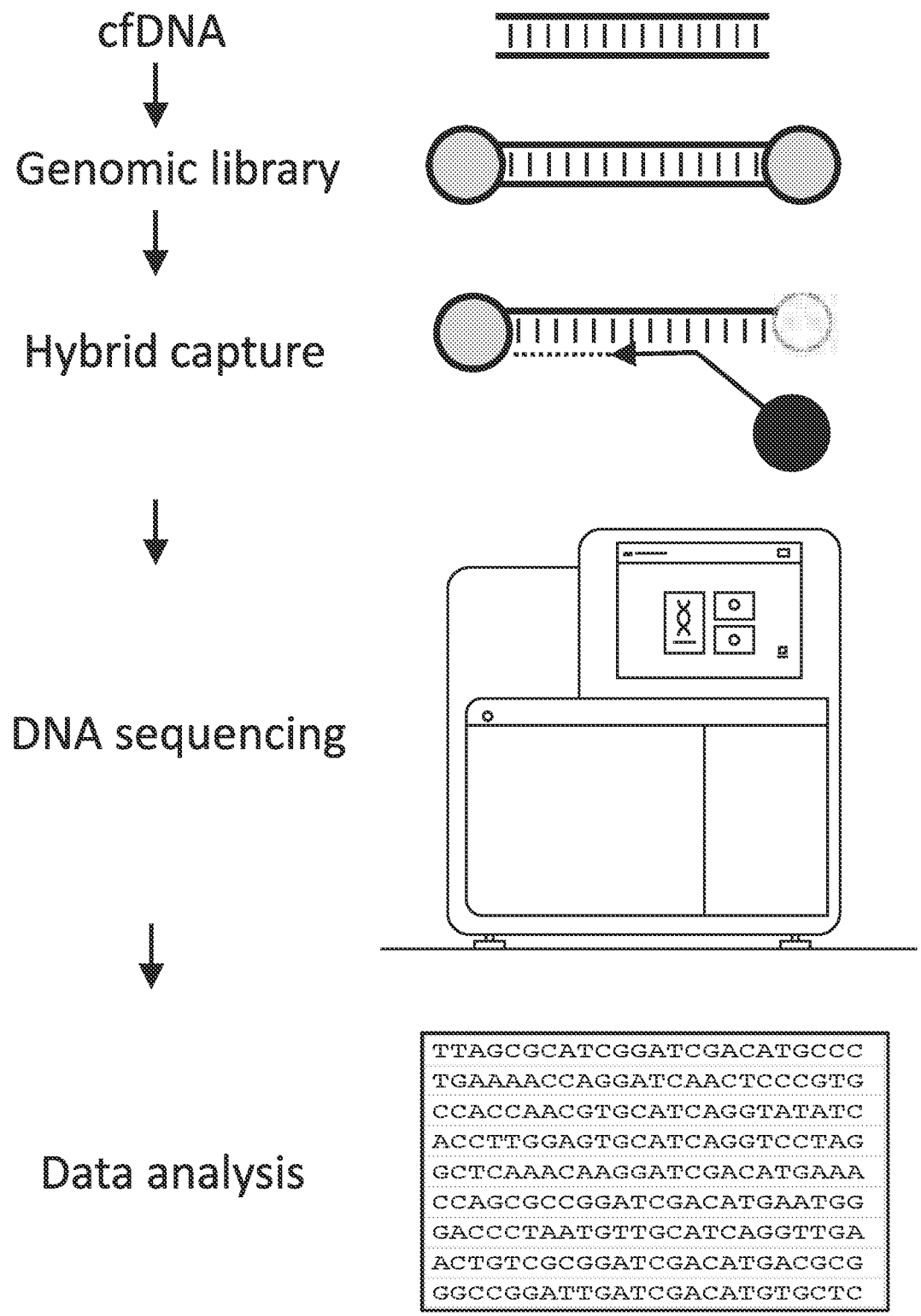
FIG. 3 shows a diagram illustrating steps of an illustrative CNL assay performed on cell free DNA (cfDNA).

An illustrative embodiment for detecting target-specific copy number changes within DNA obtained from a sample is shown in FIG. 3. While FIG. 3 generates a DNA library from cfDNA, this illustrative procedure could be used with DNA from other sources, e.g., fragmented cellular DNA. As shown in FIG. 3, cfDNA is collected (top panel). Next, a genomic library is generated from cfDNA by conjugating genomic library adaptors (gray circles) of the present invention to the genomic DNA. Genomic DNA fragments are captured with capture probes (black circles) that recognize the genomic region of interested. The genomic DNA of interest is sequenced, and data analysis is performed for copy loss analysis and/or characterization of the genomic DNA of interest.

The practice of particular embodiments of the invention will employ, unless indicated specifically to the contrary, conventional methods of chemistry, biochemistry, organic chemistry, molecular biology, microbiology, recombinant DNA techniques, genetics, immunology, and cell biology that are within the skill of the art, many of which are described below for the purpose of illustration. Such techniques are explained fully in the literature. See, e.g., Sambrook, et al., *Molecular Cloning: A Laboratory Manual* (3rd Edition, 2001); Sambrook, et al., *Molecular Cloning: A Laboratory Manual* (2nd Edition, 1989); Maniatis et al., *Molecular Cloning: A Laboratory Manual* (1982); Ausubel et al., *Current Protocols in Molecular Biology* (John Wiley and Sons, updated July 2008); *Short Protocols in Molecular Biology: A Compendium of Methods from Current Protocols in Molecular Biology*. Greene Pub. Associates and Wiley-Interscience; Glover, *DNA Cloning: A Practical Approach*, vol. I & II (IRL Press. Oxford, 1985); Anand, *Techniques for the Analysis of Complex Genomes*, (Academic Press, New York, 1992); *Transcription and Translation* (B. Hames & S. Higgins. Eds., 1984); Perbal. *A Practical Guide to Molecular Cloning* (1984); and Harlow and Lane, Antibodies. (Cold Spring Harbor Laboratory Press. Cold Spring Harbor, N.Y., 1998).

B. Definitions

Unless defined otherwise, all technical and scientific terms used herein have the same meaning as commonly understood by those of ordinary skill in the art to which the invention belongs. Although any methods and materials similar or equivalent to those described herein can be used in the practice or testing of the present invention, preferred embodiments of compositions, methods and materials are described herein. For the purposes of the present invention, the following terms are defined below.

The articles "a," "an," and "the" are used herein to refer to one or to more than one (i.e. to at least one) of the grammatical object of the article. By way of example, "an element" means one element or more than one element.

The use of the alternative (e.g., "or") should be understood to mean either one, both, or any combination thereof of the alternatives.

The term "and/or" should be understood to mean either one, or both of the alternatives.

As used herein, the term "about" or "approximately" refers to a quantity, level, value, number, frequency, percentage, dimension, size, amount, weight or length that varies by as much as 15%, 10%, 9%, 8%, 7%, 6%, 5%, 4%, 3%, 2% or 1% to a reference quantity, level, value, number, frequency, percentage, dimension, size, amount, weight or length. In one embodiment, the term "about" or "approximately" refers to a range of quantity, level, value, number, frequency, percentage, dimension, size, amount, weight or length±15%, ±10%, ±9%, ±8%, ±7%, ±6%, ±5%, ±4%, ±3%, +2%, or ±1% about a reference quantity, level, value, number, frequency, percentage, dimension, size, amount, weight or length.

Throughout this specification, unless the context requires otherwise, the words "comprise", "comprises," and "comprising" will be understood to imply the inclusion of a stated step or element or group of steps or elements but not the exclusion of any other step or element or group of steps or elements. In particular embodiments, the terms "include," "has," "contains," and "comprise" are used synonymously.

By "consisting of" is meant including, and limited to, whatever follows the phrase "consisting of." Thus, the phrase "consisting of" indicates that the listed elements are required or mandatory, and that no other elements may be present.

By "consisting essentially of" is meant including any elements listed after the phrase, and limited to other elements that do not interfere with or contribute to the activity or action specified in the disclosure for the listed elements. Thus, the phrase "consisting essentially of" indicates that the listed elements are required or mandatory, but that no other elements are optional and may or may not be present depending upon whether or not they affect the activity or action of the listed elements.

Reference throughout this specification to "one embodiment," "an embodiment," "a particular embodiment," "a related embodiment," "a certain embodiment," "an additional embodiment," or "a further embodiment" or combinations thereof means that a particular feature, structure or characteristic described in connection with the embodiment is included in at least one embodiment of the present invention. Thus, the appearances of the foregoing phrases in various places throughout this specification are not necessarily all referring to the same embodiment. Furthermore, the particular features, structures, or characteristics may be combined in any suitable manner in one or more embodiments.

As used herein, the term "isolated" means material that is substantially or essentially free from components that normally accompany it in its native state. In particular embodiments, the term "obtained" or "derived" is used synonymously with isolated.

As used herein, the term "DNA" refers to deoxyribonucleic acid. In various embodiments, the term DNA refers to genomic DNA, recombinant DNA, synthetic DNA, or cDNA. In one embodiment, DNA refers to genomic DNA or cDNA. In particular embodiments, the DNA comprises a "target region." DNA libraries contemplated herein include genomic DNA libraries and cDNA libraries constructed from RNA, e.g., an RNA expression library. In various embodiments, the DNA libraries comprise one or more additional DNA sequences and/or tags.

The terms "target genetic locus" and "DNA target region" are used interchangeably herein and refer to a region of interest within a DNA sequence. In various embodiments, targeted genetic analyses are performed on the target genetic locus. In particular embodiments, the DNA target region is a region of a gene that is associated with a particular genetic state, genetic condition, genetic diseases; fetal testing; genetic mosaicism, paternity testing; predicting response to drug treatment; diagnosing or monitoring a medical condition; microbiome profiling; pathogen screening; or organ transplant monitoring. In further embodiments, the DNA target region is a DNA sequence that is associated with a particular human chromosome, such as a particular autosomal or X-linked chromosome, or region thereof (e.g., a unique chromosome region).

As used herein, the terms "circulating DNA," "circulating cell-free DNA," and "cell-free DNA" are often used interchangeably and refer to DNA that is extracellular DNA, DNA that has been extruded from cells, or DNA that has been released from necrotic or apoptotic cells. This term is often used in contrast to "cellular genomic DNA" or "cellular DNA," which are used interchangeably herein and refer to genomic DNA that is contained within the cell (i.e. the nuclease) and is only accessible to molecular biological techniques such as those described herein, by lysing or otherwise disrupting the integrity of the cell.

A "subject," "individual," or "patient" as used herein, includes any animal that exhibits a symptom of a condition that can be detected or identified with compositions contemplated herein. Suitable subjects include laboratory animals (such as mouse, rat, rabbit, or guinea pig), farm animals (such as horses, cows, sheep, pigs), and domestic animals or pets (such as a cat or dog). In particular embodiments, the subject is a mammal. In certain embodiments, the subject is a non-human primate and, in preferred embodiments, the subject is a human.

As used herein, the term "paired" when used with respect to two different polynucleotide sequences or regions of DNA comprising different polynucleotide sequences, means that the two different polynucleotide sequences or regions of DNA comprising different polynucleotide sequences are present on the same polynucleotide. For example, if a particular sample tag region of DNA is said to be paired to particular amplification region of DNA, it is meant that the sample tag region and the amplification tag are present on the same DNA polynucleotide molecule.

C. Methods of Copy Number Analysis

In various embodiments, a method for copy number analysis of a DNA target region DNA is provided. In certain embodiments, copy number analysis is performed by generating a genomic DNA library of DNA library fragments that each contain genomic DNA fragment and an adaptor, isolating the DNA library fragments containing the DNA target regions, and performing a quantitative genetic analysis of the DNA target region. By "quantitative genetic analysis" it is meant an analysis performed by any molecular biological technique that is able to quantify changes in a DNA (e.g., a gene, genetic locus, target region of interest, etc.) including but not limited to DNA mutations, SNPs, translocations, deletions, and copy number variations (CNVs). In certain embodiments, the quantitative genetic analysis is performed by sequencing, for example, next generation sequencing.

Next-generation DNA sequencing (NGS) is ideally suited for two diagnostic applications. The first is the determination of DNA sequence on a vast scale. In the present context, this capability enables the search for rare, actionable variants that guide effective treatment decisions. The second is counting gene copy number. The output of millions of independent sequences can enable precise measurement of gene copy number on a genome-wide scale. The emergence of non-invasive prenatal testing for fetal trisomy from maternal blood samples is a testament to this capability. RNAseq, that is, the technology of gene expression profiling using NGS is another example, albeit the input is RNA (cDNA) rather than genomic DNA. Comparisons of current capture methods are described Samorodnitsky et al. J Mol Diagn. 2015 January; 17(1):64-75.

The present invention extends NGS counting capability into the realm of targeted hybrid capture methods. The methods described here are effective for the detection of copy number variation at least in part because they possess the following four qualities:

(a) The present methods differentiate between unique clones and redundant clones. NGS sequencing of amplified genomic DNA library fragments results in a plurality of individual NGS reads, each comprising adaptor-encoded sequence information linked to a specific human genomic sequence. These elements define the identity of every clone. Because captured genomic regions are amplified by PCR, it is not uncommon for the same clone to be encountered several times in a subsequent NGS analysis. Groups of reads that are derived from a single cloning and capture process are termed "redundant reads." Two or more redundant reads are identified as redundant reads based on the sequencing information provided by the unique molecular identification elements (UMIE). The UMIE refers to the combination of the sequence information from the adaptor tags and the start of the genomic DNA sequence. Two or more reads comprising identical UMIEs are identified as redundant reads. Redundant reads are grouped together and a single, representative consensus sequence is assembled from families of redundant reads. This consensus sequence is designated as a "unique read" or a "unique genomic sequence" (UGS). Each unique read represents a separate clone from the original DNA specimen. The process of identifying and grouping redundant clone families and of generating a single unique read representative of this family is defined as "deduplication." The adaptors used to create genomic libraries possess a very deep repertoire of unique sample tag information (15,360 codes per adaptor). When applied in conjunction with the exact mapping coordinates of each captured genomic clone (which can span >100 different positions relative to a capture probe), each unique clone that is generated in a genomic library and subsequently retrieved by a target-specific capture probe has an extremely high likelihood of being differentiable from all other unique clones that encompass the same capture environment. The ability to differentiate between unique clones and redundant clones is central to the methods described herein.

(b) The adaptors used to create genomic libraries permit sample multiplexing without creating adaptor-to-adaptor variability in copy number counts. A central foundation of copy number determination is the simultaneous analysis of a set of samples that have all been processed within a single sequencing run. This allows positive and negative controls to be included along with clinical samples. A major issue with previous adaptor design iterations induced subtle shifts in gene copy counts among identical control samples, in effect setting a signal-to-noise uncertainty threshold that was too high to be clinically useful in blood-based, solid tumor genotyping assays. The present invention overcomes this issue and substantially lowers the signal-to-noise threshold such that single copy gene loss is detectable at ≤2% minor allele frequency. This improved signal recognition enables the methods of the present invention to have significant clinical utility in circulating tumor DNA assays.

(c) The proprietary targeted hybrid capture method used herein must produce highly uniform "on-target" read coverage across all targets. Methods that rely on counting of unique genomic fragments to estimate copy number, such as the ones described herein, must achieve near-saturation in terms of encountering all possible unique fragments. Near-saturation is only achieved by oversampling, that is to say, gathering more sequencing reads than the number of unique reads that will ultimately be encountered. To be practical, scalable, and economical, the unique reads in a targeted hybrid capture library must exhibit sufficient uniformity such that <10-fold oversampling of on-target reads, and preferably <4-fold oversampling of on-target reads will capture >90% of unique on-target reads at all target loci.

(d) The targeted hybrid capture method (See U.S. Patent Publication No. 2014-0274731) must have high on-target capture rates. To be practical, scalable and economical, in other words to be a distinguishing feature of the present disclosure relative to other art in the field, the method must achieve >90%, preferably >95% on-target reads. With on-target mapping rates exceeding 95%, the requirement for 4 to 10-fold oversampling of on-target reads and the requirement for overall oversampling are one in the same.

In some embodiments, the number of copies of the DNA target region present in the sample is determined by the quantitative genetic analysis. In some embodiments, the copy number of the DNA target region is determined by comparing the amount of copies of DNA target regions present in the sample and comparing it to amounts of DNA target regions present in one or more samples with known copy number.

Particular embodiments contemplate that the compositions and methods described herein are particularly useful for detecting changes in copy number in a sample of genomic DNA, where only a portion of the total genomic DNA in the sample has a change in copy number. For example, a significant tumor mutation may be present in a sample, e.g. a sample of cell free DNA, that is present in a minor allele frequency that is significantly less than 50% (e.g., in the range of 0.1% to >20%), in contrast to conventional SNP genotyping where allele frequencies are generally ~100%, 50% or 0%. One of skill of the art will recognize that the compositions and methods of the current invention are also useful in detecting other types of mutation including single nucleotide variants (SNVs), short (e.g., less than 40 base pairs (bp)) insertions, and deletions (indels), and genomic rearrangements including oncogenic gene fusions.

In certain embodiments, the compositions and/or methods of the present invention described herein are useful for, capable of, suited for, and/or able to detect, identify, observe, and/or reveal a change in copy number of one or more DNA target regions present in less than about 20%, less than about 19%, less than about 18%, less than about 17%, less than about 16%, less than about 15%, less than about 14%, less than about 13%, less than about 12%, less than about 11%, less than about 10%, less than about 9%, less than about 8%, less than about 7%, less than about 6%, less than about 5%, less than about 4%, less than about 3%, less than about 2%, less than about 1%, less than about 0.5%, less than about 0.2%, or less than about 0.1% of the total genomic DNA from the sample. In some embodiments, the methods of the present invention are useful for, capable of, suited for, and/or able to detect, identify, observe, and/or reveal a change in copy number of one or more DNA target regions present in between about 0.01% to about 100%, about 0.01% to about 50%, and or about 0.1% to about 20% of the total genomic DNA from the sample.

Particular embodiments are represented by the conceptual framework that is illustrated in FIG. 1. In FIG. 1, each gene is represented by a row and each patient sample is represented as a column. Within any given genomic DNA sample, the number of fragments counted for each individual gene will have some variability, and that for any given DNA region of interest, e.g. a gene, perturbations in copy number are detected as significant fragment count deviations relative to the normalized counts to the DNA target region in other samples. Such an assay requires the gene-by-gene fragment counting profile within a sample to be reproducible, and also requires the sample-by-sample counting profiles to be highly comparable. Both assay requirements demand excellent signal-to-noise counting discrimination.

Figure 2:
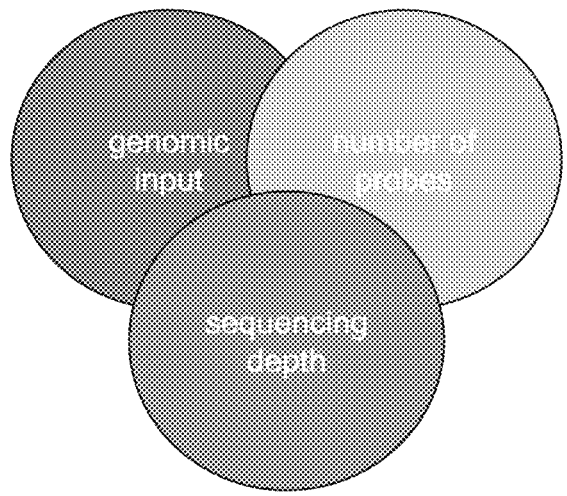
FIG. 2 shows a diagram illustrating the drivers of the CNL assay signal.

Some embodiments contemplate that the assay elements that contribute to increasing the signal to noise ratio are the genomic input, the number of probes, and the sequencing depth, as illustrated in FIG. 2.

In particular embodiments, a method for genetic analysis of cfDNA comprises: generating and amplifying a cfDNA library, determining the number of genome equivalents in the cfDNA library; and performing a quantitative genetic analysis of one or more genomic target loci.

Particular embodiments contemplate that the any of the methods and compositions described herein are effective for use to efficiently analyze, detect, diagnose, and/or monitor genetic states, genetic conditions, genetic diseases, genetic mosaicism, fetal diagnostics, paternity testing, microbiome profiling, pathogen screening, and organ transplant monitoring using genomic DNA, e.g., cellular or cfDNA, where all or where only a portion of the total genomic DNA in the sample has a feature of interest, e.g. a genetic lesion, mutation, single nucleotide variant (SNV). In some embodiments, a feature of interest is a genetic feature associated with a disease or condition. For example, a significant tumor mutation may be present in a sample, e.g. a sample of cfDNA, that is present in a minor allele frequency that is significantly less than 50% (e.g. in the range of 0.1% to >20%), in contrast to conventional SNP genotyping where allele frequencies are generally ~100%, 50% or 0%.

In certain embodiments, the compositions and/or methods of the present invention described herein are useful for, capable of, suited for, and/or able to detect, identify, observe, and/or reveal a genetic lesion of one or more DNA target regions present in less than about 20%, less than about 19%, less than about 18%, less than about 17%, less than about 16%, less than about 15%, less than about 14%, less than about 13%, less than about 12%, less than about 11%, less than about 10%, less than about 9%, less than about 8%, less than about 7%, less than about 6%, less than about 5%, less than about 4%, less than about 3%, less than about 2%, less than about 1%, less than about 0.5%, less than about 0.2%, or less than about 0.1% of the total genomic DNA from the sample. In some embodiments, the methods of the present invention are useful for, capable of, suited for, and/or able to detect, identify, observe, and/or reveal a genetic lesion of one or more DNA target regions present in between about 0.01% to about 100%, about 0.01% to about 50%, and or about 0.1% to about 20% of the total genomic DNA from the sample.

1. Generating a DNA Library

In particular embodiments, methods of genetic analysis contemplated herein comprise generating a DNA library comprising treating cfDNA or fragmented cellular genomic DNA with one or more end-repair enzymes to generate end-repaired DNA and attaching one or more adaptors to each end of the end-repaired DNA to generate the DNA library. Genomic DNA In particular embodiments, the methods and compositions contemplated herein are designed to efficiently analyze, detect, diagnose, and/or monitor change in copy number using genomic DNA as an analyte. In certain embodiments, copy number analysis is performed by generating a genomic DNA library from genomic DNA obtained from a test sample, e.g., a biological sample such as a tissue biopsy. In certain embodiments, the genomic DNA is circulating or cell free DNA. In some embodiments, the genomic DNA is cellular genomic DNA.

In certain embodiments, genomic DNA is obtained from a tissue sample or biopsy taken from a tissue, including but not limited to, bone marrow, esophagus, stomach, duodenum, rectum, colon, ileum, pancreases, lung, liver, prostate, brain, nerves, meningeal tissue, renal tissue, endometrial tissue, cervical tissue, breast, lymph node, muscle, and skin. In certain embodiments, the tissue sample is a biopsy of a tumor or a suspected tumor. In particular embodiments, the tumor is cancerous or suspected of being cancerous. In particular embodiments, the tissue sample comprises cancer cells or cells suspected of being cancerous.

Methods for purifying genomic DNA from cells or from a biologic tissue comprised of cells are well known in the art, and the skilled artisan will recognize optimal procedures or commercial kits depending on the tissue and the conditions in which the tissue is obtained. Some embodiments contemplate that purifying cellular DNA from a tissue will require cell disruption or cell lysis to expose the cellular DNA within, for example by chemical and physical methods such as blending, grinding or sonicating the tissue sample; removing membrane lipids by adding a detergent or surfactants which also serves in cell lysis, optionally removing proteins, for example by adding a protease; removing RNA, for example by adding an RNase; and DNA purification, for example from detergents, proteins, salts and reagents used during cell lysis step. DNA purification may be performed by precipitation, for example with ethanol or isopropanol; by phenol-chloroform extraction.

In particular embodiments, cellular DNA obtained from tissues and/or cells are fragmented prior to and or during obtaining, generating, making, forming, and/or producing a genomic DNA library as described herein. One of skill in the art will understand that there are several suitable techniques for DNA fragmentation, and is able to recognize and identify suitable techniques for fragmenting cellular DNA for the purposes of generating a genomic DNA library for DNA sequencing, including but not limited to next-generation sequencing. Certain embodiments contemplate that cellular DNA can be fragmented into fragments of appropriate and/or sufficient length for generating a library by methods including but not limited to physical fragmentation, enzymatic fragmentation, and chemical shearing.

Physical fragmentation can include, but is not limited to, acoustic shearing, sonication, and hydrodynamic shear. In some embodiments, cellular DNA is fragmented by physical fragmentation. In particular embodiments, cellular DNA is fragmented by acoustic shearing or sonication. Particular embodiments contemplate that acoustic shearing and sonication are common physical methods used to shear cellular DNA. The Covaris® instrument (Woburn, Mass.) is an acoustic device for breaking DNA into 100-5 kb bp. Covaris also manufactures tubes (gTubes) which will process samples in the 6-20 kb for Mate-Pair libraries. The Bioruptor® (Denville, N.J.) is a sonication device utilized for shearing chromatin, DNA and disrupting tissues. Small volumes of DNA can be sheared to 150-1 kb in length. Hydroshear from Digilab (Marlborough, Mass.) utilizes hydrodynamic forces to shear DNA. Nebulizers (Life Tech, Grand Island, N.Y.) can also be used to atomize liquid using compressed air, shearing DNA into 100-3 kb fragments in seconds. Nebulization is low cost, but the process can cause a loss of about 30% of the cellular DNA from the original sample. In certain embodiments, cellular DNA is fragmented by sonication.

Enzymatic fragmentation can include, but is not limited to, treatment with a restriction endonuclease, e.g. DNase I, or treatment with a nonspecific nuclease. In some embodiments, cellular DNA is fragmented by enzymatic fragmentation. In particular embodiments, the cellular DNA is fragmented by treatment with a restriction endonuclease. In some embodiments, the cellular DNA is fragmented by treatment with a nonspecific nuclease. In certain embodiments, the cellular DNA is fragmented by treatment with a transposase. Certain embodiments contemplate that enzymatic methods to shear cellular DNA into small pieces include DNAse I, a combination of maltose binding protein (MBP)-T7 Endo I and a non-specific nuclease *Vibrio vulnificus* (Vvn) New England Biolabs's (Ipswich, Mass.) Fragmentase and Nextera tagmentation technology (Illumina, San Diego. Calif.). The combination of non-specific nuclease and T7 Endo synergistically work to produce non-specific nicks and counter nicks, generating fragments that disassociate 8 nucleotides or less from the nick site. Tagmentation uses a transposase to simultaneously fragment and insert adapters onto double stranded DNA.

Chemical fragmentation can include treatment with heat and divalent metal cation. In some embodiments, genomic DNA is fragmented by chemical fragmentation. Particular embodiments contemplate that chemical shear is more commonly used for the breakup of long RNA fragments as opposed to genomic DNA. Chemical fragmentation is typically performed through the heat digestion of DNA with a divalent metal cation (magnesium or zinc). The length of DNA fragments can be adjusted by increasing or decreasing the time of incubation.

In particular embodiments, the methods and compositions contemplated herein are designed to efficiently analyze, detect, diagnose, and/or monitor change in copy number using cell-free DNA (cfDNA) as an analyte. The size distribution of cfDNA ranges from about 150 bp to about 180 bp fragments. Fragmentation of cfDNA may be the result of endonucleolytic and/or exonucleolytic activity and presents a formidable challenge to the accurate, reliable, and robust analysis of cfDNA. Another challenge for analyzing cfDNA is its short half-life in the blood stream, on the order of about 15 minutes. Without wishing to be bound to any particular theory, the present invention contemplates, in part, that analysis of cfDNA is like a "liquid biopsy" and is a real-time snapshot of current biological processes.

Moreover, because cfDNA is not found within cells and may be obtained from a number of suitable sources including, but not limited to, biological fluids and stool samples, it is not subject to the existing limitations that plague next generation sequencing analysis, such as direct access to the tissues being analyzed.

Illustrative examples of biological fluids that are suitable sources from which to isolate cfDNA in particular embodiments include, but are not limited to amniotic fluid, blood, plasma, serum, semen, lymphatic fluid, cerebral spinal fluid, ocular fluid, urine, saliva, mucous, and sweat. In particular embodiments, the biological fluid is blood or blood plasma.

In certain embodiments, commercially available kits and other methods known to the skilled artisan can used to isolate cfDNA directly from the biological fluids of a subject or from a previously obtained and optionally stabilized biological sample. e.g., by freezing and/or addition of enzyme chelating agents including, but not limited to EDTA, EGTA, or other chelating agents specific for divalent cations.

(a) Generating End-Repaired cfDNA

In particular embodiments, generating a genomic DNA library comprises the end-repair of isolated cfDNA or fragmented cellular DNA. The fragmented cfDNA or cellular DNA is processed by end-repair enzymes to generate end-repaired cfDNA with blunt ends, 5'-overhangs, or 3'-overhangs. In some embodiments, the end-repair enzymes can yield for example. In some embodiments, the end-repaired cfDNA or cellular DNA contains blunt ends. In some embodiments, the end-repaired cellular DNA or cfDNA is processed to contain blunt ends. In some embodiments, the blunt ends of the end-repaired cfDNA or cellular DNA are further modified to contain a single base pair overhang. In some embodiments, end-repaired cfDNA or cellular DNA containing blunt ends can be further processed to contain adenine (A)/thymine (T) overhang. In some embodiments, end-repaired cfDNA or cellular DNA containing blunt ends can be further processed to contain adenine (A)/thymine (T) overhang as the single base pair overhang. In some embodiments, the end-repaired cfDNA or cellular DNA has non-templated 3' overhangs. In some embodiments, the end-repaired cfDNA or cellular DNA is processed to contain 3' overhangs. In some embodiments, the end-repaired cfDNA or cellular DNA is processed with terminal transferase (TdT) to contain 3' overhangs. In some embodiments, a G-tail can be added by TdT. In some embodiments, the end-repaired cfDNA or cellular DNA is processed to contain overhang ends using partial digestion with any known restriction enzymes (e.g., with the enzyme Sau3A, and the like.

(b) Attaching Adaptor Molecules to End-Repaired cfDNA

In particular embodiments, generating a cfDNA library comprises attaching one or more adaptors to each end of the end-repaired cfDNA. The present invention contemplates, in part, an adaptor module designed to accommodate large numbers of genome equivalents in cfDNA libraries. Adaptor modules are configured to measure the number of genome equivalents present in cfDNA libraries, and, by extension, the sensitivity of sequencing assays used to identify sequence mutations.

As used herein, the terms "adaptor" and "adaptor module" are used for interchangeably, and refer to a polynucleotide comprising that comprises at least three elements: an amplification region, a sample tag region, and an anchor region. In particular embodiments, the adaptor comprises an amplification region, a sample tag region, and an anchor region. In some embodiments, the adaptor also comprises a unique molecule identifier (UMI). In particular embodiments, the adaptor comprises one or amplification regions, one or more sample tag regions, one or more UMIs, and/or one or more anchor regions. In some embodiments, the adaptor comprises, in order from 5' to 3', an amplification region, a sample tag region, a UMI, and an anchor region. In particular embodiments, the adaptor comprises, in order from 5' to 3', an amplification region, a sample tag region, a UMI, and an anchor region. In certain embodiments, the UMI is contained within the sample tag region, and the adaptor comprises, in order from 5' to 3', an amplification region, an integrated sample tag/UMI region, and an anchor region.

As used herein, the term "amplification region" refers to an element of the adaptor molecule that comprises a polynucleotide sequence capable of serving as a primer recognition site for PCR amplification. In particular embodiments, an adaptor comprises an amplification region that comprises one or more primer recognition sequences for single-primer amplification of a genomic DNA library. In some embodiments, the amplification region comprises one, two, three, four, five, six, seven, eight, nine, ten, or more primer recognition sequences for single-primer amplification of a genomic DNA library.

In some embodiments, the amplification region is about is between 5 and 50 nucleotides, between 10 and 45 nucleotides, between 15 and 40 nucleotides, or between 20 and 30 nucleotides in length. In some embodiments, the amplification region is 10 nucleotides, 11 nucleotides, 12 nucleotides, 13 nucleotides, 14 nucleotides, 15 nucleotides, 16 nucleotides, 17 nucleotides, about 18 nucleotides, 19 nucleotides, 20 nucleotides, 21 nucleotides, 22 nucleotides, 23 nucleotides, 24 nucleotides, 25 nucleotides, 26 nucleotides, 27 nucleotides, 28 nucleotides, 29 nucleotides, 30 nucleotides, 31 nucleotides, 32 nucleotides, 33 nucleotides, 34 nucleotides, 35 nucleotides, 36 nucleotides, 37 nucleotides, 38 nucleotides, 39 nucleotides, or 40 nucleotides or more. In particular embodiments, the amplification region is 25 nucleotides in length.

As used herein, the term "sample tag" or sample tag region" are used interchangeably and refer to an element of the adaptor that comprises a polynucleotide sequence that uniquely identifies the particular DNA fragment as well as the sample from which it was derived.

In certain embodiments, the sample tag region is about is between 3 and 50 nucleotides, between 3 and 25 nucleotides, or between 5 and 15 nucleotides in length. In some embodiments, the sample tag region is 3 nucleotides, 4 nucleotides, 5 nucleotides, 6 nucleotides, 7 nucleotides, 8 nucleotides, 9 nucleotides, 10 nucleotides, about 11 nucleotides, 12 nucleotides, 13 nucleotides, 14 nucleotides, 15 nucleotides, 16 nucleotides, 17 nucleotides, 18 nucleotides, 19 nucleotides, or 20 nucleotides or more in length.

In certain embodiments, the adaptor comprises a UMI multiplier, wherein the UMI multiplier is at least 1, at least 2, at least 3, at least 4, at least 5, at least 6, at least 7, at least 8, at least 9, or at least 10 nucleotides in length.

In certain embodiments, each nucleotide position of the UMI multiplier can comprise any of adenine, guanine, cytosine, or thymine. Thus, in some embodiments, a UMI multiplier comprising n number of nucleotides can comprise any of $n^4$ possible nucleotide sequences. In some embodiments, the UMI multiplier is one nucleotide in length and comprises one of four possible sequences. In some embodiments, the UMI multiplier is two nucleotides in length and comprises one of sixteen possible sequences. In some embodiments, the UMI multiplier is three nucleotides in length and comprises one of 64 possible sequences. In some embodiments, the UMI multiplier is four nucleotides in length and comprises one of 256 possible sequences. In some embodiments, the UMI multiplier is five nucleotides in length and comprises one of 1,024 possible sequences. In some embodiments, the UMI multiplier is six nucleotides in length and comprises one of 4,096 possible sequences. In some embodiments, the UMI multiplier is seven nucleotides in length and comprises one of 16,384 possible sequences. In some embodiments, the UMI multiplier is eight nucleotides in length and comprises one of 65,5336 possible sequences. In some embodiments, the UMI multiplier is nine nucleotides in length and comprises one of 262,144 possible sequences. In some embodiments, the UMI multiplier is ten or more nucleotides in length and comprises one of 1,048, 576 or more possible sequences.

Figure 5A:
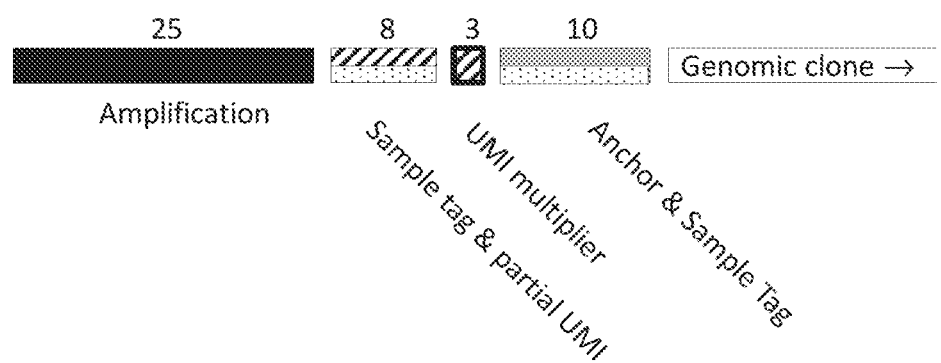
FIG. 5A-FIG. 5B shows a diagram illustrating that shifting the position of the UMI multiplier within the sample tag can increase the number of unique sample tags.
Figure 5B:
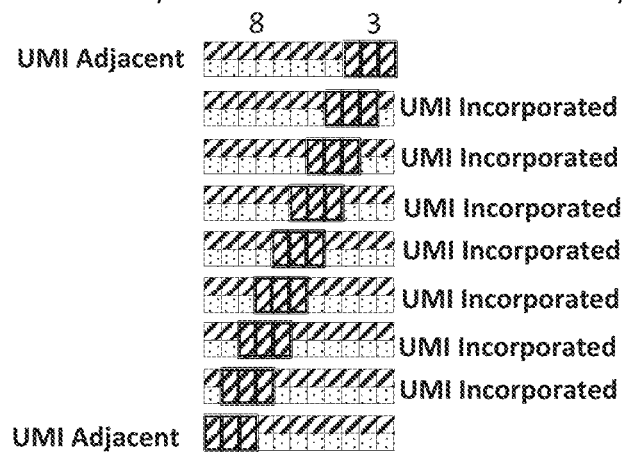

In particular embodiments, the adaptor comprises a UMI multiplier, wherein the UMI multiplier is adjacent to or contained within the sample tag region (FIG. 5A). Illustrative examples of UMI multipliers adjacent or contained within the sample tag are shown in FIG. 5B. In FIG. 5B, an 8-mer sample tag region is shown with an adjacent UMI multiplier (top and bottom rows) or a UMI multiplier incorporated within the sample tag (middle 7 rows). In some embodiments, that adaptor comprises a sample tag that is eight nucleotides in length and a UMI multiplier that is three nucleotides in length and comprises one of 64 possible sequences, and wherein the UMI multiplier is adjacent to or contained within the sample tag region. In some embodiments, identical processes attach full length adaptor to the other end of the genomic fragments.

In particular embodiments, an adaptor module comprises one or more anchor sequences. As used herein, an "anchor region" and "anchor sequence" are used interchangeably and refer to a nucleotide sequence that hybridizes to a partner oligonucleotide. In some embodiments, the anchor region comprises the following three properties: (1) each anchor sequence is part of a family of two or more anchor sequences that collectively represent each of the four possible DNA bases at each site within extension; this feature, balanced base representation, is useful to calibrate proper base calling in sequencing reads in particular embodiments; (2) each anchor sequence is composed of only two of four possible bases, and these are specifically chosen to be either and equal number of A+C or an equal number of G+T; an anchor sequence formed from only two bases reduces the possibility that the anchor sequence will participate in secondary structure formation that would preclude proper adaptor function; and (3) because each anchor sequence is composed of equal numbers of A+C or G+T, each anchor sequence shares roughly the same melting temperature and duplex stability as every other anchor sequence in a set of four.

In some embodiments, the anchor sequences is between 1 and 50 nucleotides in length. In some embodiments, the anchor sequences is between 4 and 40 nucleotides in length. In certain embodiments, the anchor region is between 5 and 25 nucleotides in length. In particular embodiments, the anchor region is at least 4 nucleotides, at least six nucleotides, at least 8 nucleotides, at least 10 nucleotides, at least 12 nucleotides, at least 14 nucleotides, or at least 16 nucleotides in length. In particular embodiments, the anchor region is 10 nucleotides in length.

In particular embodiments, an attachment step comprises attaching/ligating an adaptor module to the end-repaired cfDNA or cellular DNA to generate a "tagged" genomic DNA library. In some embodiments, a single adaptor module is employed. In some embodiments, two, three, four or five adaptor modules are employed. In some embodiments, an adaptor module of identical sequence is attached to each end of the fragmented end-repaired DNA.

In some embodiments, a plurality of adaptor species is attached to an end-repaired cellular or cell free genomic DNA fragments. Each of the plurality of adaptors may comprise one or more amplification regions for the amplification of the cfDNA or cellular DNA library, one or more sample tag regions for the identification of the cfDNA or cellular genomic DNA fragment and identification of the individual sample; and one or more sequences for DNA sequencing.

In some embodiments, a plurality of adaptor species is attached to an end-repaired cellular or cell free genomic DNA fragments of a sample, and the plurality of adaptors all comprise amplification regions of an identical nucleotide sequence.

In certain embodiments, the genomic DNA from a sample is attached with a plurality of adaptors that comprise sample tag sequences that all are different from other sequences of sample tag regions in adaptors that are attached to genomic DNA fragments from other samples.

In particular embodiments, a plurality of adaptor species is attached to an end-repaired cellular or cell free genomic DNA fragments from a sample, and the plurality of adaptors all comprise one or more sample tag regions comprising one of between 2 and 10,000 nucleotide sequences, one of between 5 and 5,000 nucleotide sequences, one of between 25 and 1,000 nucleotide sequences, one of between 50 and 500 nucleotide sequences one of between 100 and 400 nucleotide sequences, or one of between 200 and 300 nucleotide sequences. In some embodiments, the sample tag region of each adaptor is 8 nucleotides in length, and each sample tag region of the plurality of adaptors comprises one of 240 nucleotide sequences.

In certain embodiments, a plurality of adaptor species is attached to an end-repaired cellular or cell free genomic DNA fragments from a sample, and the sample tag regions of the plurality of adaptors comprises nucleotide sequences that are different from each other by a Hamming distance of 1, 2, 3, 4 or greater than 4. In particular embodiments, the Hamming distance is 2.

In particular embodiments, the sample tag regions of the plurality of adaptors that are attached to genomic DNA fragments of a sample are 8 nucleotides in length, and comprise one of 240 nucleotide sequences that are different from each other by a Hamming distance of 2.

In certain embodiments, the sample tag region serves to identify individual genomic DNA fragments and to identify the individual sample, i.e., the genomic library source. For example, when the sample tags of a plurality of adaptors attached to a sample have one of 240 possible sequences, each sample is identified as having one of 240 possible tags, and each sample receives a set of 240 tags that are discrete from any other sample by Hamming distance of two (meaning two base changes are required to change one tag into another). These same tags are used to enumerate clone diversity and thus they also serve as sequence tags, i.e., to identify genomic DNA fragments. To further augment the diversity of possible sequence tags, UMI multipliers may be added. For example, a UMI multiplier can be added to the adaptor region comprising 3 nucleotides consisting of the 64 possible combinations of 3 bases. In addition, the plurality of adaptors can comprise more than one anchor sequence. For example, a plurality of adaptors may contain 4 different anchor sequences are used simultaneously. These anchor sequences may also be used during sample de-multiplexing to lower errors.

Figure 4A:
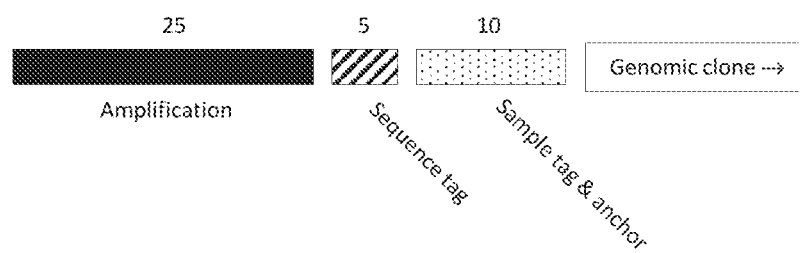
FIG. 4A-FIG. 4E shows diagrams of an illustrative first generation adaptor (FIG. 4A and FIG. 4B) and an adaptor of the present invention (FIG. 4C-FIG. 4E).
Figure 4B:
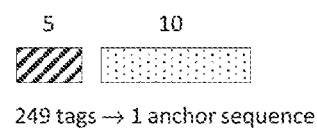
Figure 4C:
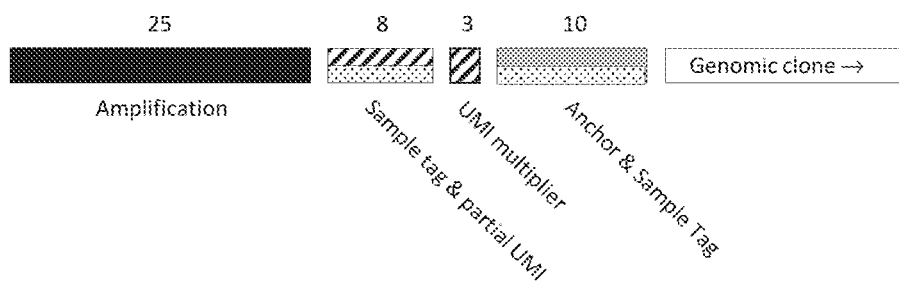
Figure 4D:
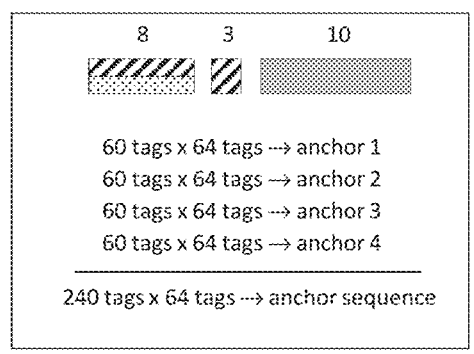
Figure 4E:

FIG. 4 shows an illustrative comparison between a first generation adaptor (FIGS. 4A and 4B) and an adaptor of the present invention (FIG. 4C-FIG. 4E). FIG. 4A and FIG. 4B show an example of first generation adaptor that is 40 nt in length and consisted of a discrete PCR amplification sequence, sequence tag, and sample tag. Here, the sample is identified by a fixed sequence (sequence tag) that is present on all adaptors that are used to generate a DNA library from the sample. Individual genomic fragments are identified by a separate and distinct sequences (sequence tag). FIG. 4C-FIG. 4E show an illustrative example of an adaptor from the present invention. The illustrative adaptor shown is 47 nucleotides in length, and the sequence tag is combined with the sample tag. There is an additional 3 nt sequence, the UMI multiplier, consisting of the 64 possible combinations of 3 bases. The 10 nt anchor sequence is one of four different distinct sequences.

Thus, in the illustrative example (See FIG. 4C-FIG. 4E), a set of adaptors that are used in connection with a single sample comprise 240 sample tag sequences that can be split into four sets of sample tag sequences with each set comprising 60 tags (one for each nucleotide. A, C, T and G). Thus, each set of 60 tags is specific to one of four anchor sequences. In total, a pool of 240 possible sample tag configurations are possible per sample. Specifically, in this scenario, the 240 sample tag sequences are divided into four sets of 60 sequences, with each set directed to a specific anchor region. Therefore, the sample ID involves not only the sequence information from the eight nucleotide sample tag, but also the associated anchor sequence information. In addition, the position of sequences within the read is fixed, and therefore the sample tags and anchor sequences must have a fixed position within a sequencing read in order to pass inclusion filters for downstream consideration. Further, the inclusion of the UMI multiplier increases the sequence tag diversity from 240 to 240×64=15,360 possible sequence tags.

Attachment of one or more adaptors contemplated herein may be carried out by methods known to those of ordinary skill in the art. In particular embodiments, one or more adaptors contemplated herein are attached to end-repaired cfDNA that comprises blunt ends. In certain embodiments, one or more adaptors contemplated herein are attached to end-repaired cfDNA that comprises complementary ends appropriate for the attachment method employed. In certain embodiments, one or more adaptors contemplated herein are attached to end-repaired cfDNA that comprises a 3' overhang.

In some embodiments, attaching the genomic DNA fragments to a plurality of adaptors includes the steps of attaching the end repaired cfDNA or cellular DNA fragments to an oligonucleotide containing at least a portion of an anchor region. In some embodiments, the oligonucleotide contains the whole anchor region. In particular embodiments, the oligonucleotide is a DNA duplex comprising a 5' phosphorylated attachment strand duplexed with a partner strand, wherein the partner strand is blocked from attachment by chemical modification at its 3' end, and wherein the attachment strand is attached to the genomic DNA fragment. In certain embodiments, the DNA fragments attached with at least a portion of the anchor region are then annealed with DNA oligonucleotides encoding the full length adaptor sequences. In particular embodiments, one or more polynucleotide kinases, one or more DNA ligases, and/or one or more DNA polymerases are added to the genomic DNA fragments and the DNA oligonucleotides encoding the full length adaptor sequence. In some embodiments, the polynucleotide kinase is T4 polynucleotide kinase. In some embodiments, the DNA ligase is Taq DNA ligase. In certain embodiments, the DNA polymerase is Taq polymerase. In particular embodiments, the DNA polymerase is full length Bst polymerase.

Figure 6A:
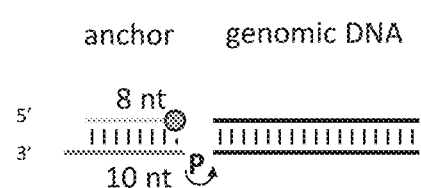
FIG. 6A and FIG. 6B shows a diagram illustrating the process of constructing genomic libraries for a CNL assay.
Figure 6B:
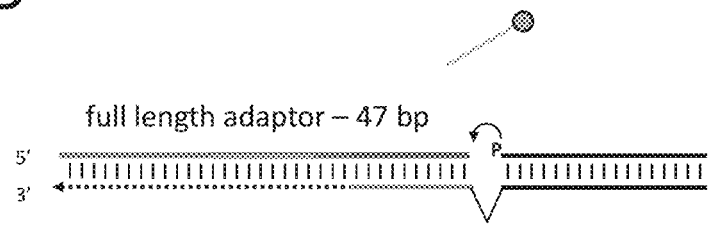

FIG. 6 shows an illustrative method for attaching a plurality of adaptors to the 3' end of repaired DNA fragments. In the first step, the anchor sequence is attached to the 3' ends of genomic fragments. In this step, the anchor portion is a DNA duplex in which the ten nucleotide 5' phosphorylated "attachment strand" is duplexed with an eight nucleotide "partner strand" that is blocked from attachment by chemical modification at its 3' end. The anchor duplex is blunt-ended on the phosphorylated/blocked end and can therefore attach to blunt-ended genomic fragments. In the next step, pools of oligonucleotides encoding the full adaptor sequences are annealed to the initial anchor sequence. The combined action of T4 polynucleotide kinase, Taq DNA ligase, and full-length Bst polymerase attach this oligonucleotide via ligation as illustrated for the top strand and extend the initial anchor sequence by DNA polymerization on the bottom strand to complete the full-length adaptor sequence. Identical processes may be used to attach full length adaptors to the 5' end of the genomic fragments.

2. DNA Library Amplification

In particular embodiments, methods of genetic analysis contemplated herein comprise amplification of a genomic DNA library, e.g. a cellular DNA library or a cfDNA library, to generate a DNA clone library or a library of DNA clones, e.g., a cfDNA clone library or a library of cfDNA clones, or a cellular DNA clone library or a library of cellular DNA clones. Each molecule of the DNA library comprises an adaptor attached to each end of an end-repaired DNA fragments, and each adaptor comprises one or more amplification regions. In some embodiments, different adaptors are attached to different ends of the end-repaired cfDNA. In particular embodiments, different adaptors are attached to different ends of the end-repaired cellular DNA.

In some embodiments, the same adaptor is attached to both ends of the DNA fragment. Attachment of the same adaptor to both ends of end-repaired DNA allows for PCR amplification with a single primer sequence. In particular embodiments, a portion of the adaptor attached-cfDNA library will be amplified using standard PCR techniques with a single primer sequence driving amplification. In one embodiment, the single primer sequence is about 25 nucleotides, optionally with a projected Tm of ≥55° C. under standard ionic strength conditions.

In particular embodiments, picograms of the initial genomic DNA library, e.g. a cellular DNA library or cfDNA library, are amplified into micrograms of DNA clones, implying a 10,000-fold amplification. The amount of amplified product can be measured using methods known in the art. e.g., quantification on a Qubit 2.0 or Nanodrop instrument.

3. Determining the Number of Genome Equivalents

In various embodiments, a method for genetic analysis of genomic DNA comprises determining the number of genome equivalents in the DNA clone library. As used herein, the term "genome equivalent" refers to the number of genome copies in each library. An important challenge met by the compositions and methods contemplated herein is achieving sufficient assay sensitivity to detect and analysis rare genetic mutations or differences in genetic sequence. To determine assay sensitivity value on a sample-by-sample basis, the numbers of different and distinct sequences that are present in each sample are measured by measuring the number of genome equivalents that are present in a sequencing library. To establish sensitivity, the number of genome equivalents must be measured for each sample library.

The number of genome equivalents can be determined by qPCR assay or by using bioinformatics-based counting after sequencing is performed. In the process flow of clinical samples, qPCR measurement of genome equivalents is used as a QC step for DNA libraries, e.g., cfDNA libraries or genomic DNA libraries. It establishes an expectation for assay sensitivity prior to sequence analysis and allows a sample to be excluded from analysis if its corresponding DNA clone library lacks the required depth of genome equivalents. Ultimately, the bioinformatics-based counting of genome equivalents—and hence the assay sensitivity and false negative estimates—for each given DNA clone library.

The empirical qPCR assay and statistical counting assays should be well correlated. In cases where sequencing fails to reveal the sequence depth in a DNA clone library, reprocessing of the DNA clone library and/or additional sequencing may be required.

In one embodiment, the genome equivalents in a cellular DNA or cfDNA clone library are determined using a quantitative PCR (qPCR) assay. In a particular embodiment, a standard library of known concentration is used to construct a standard curve and the measurements from the qPCR assay are fit to the resulting standard curve and a value for genome equivalents is derived from the fit. The present inventors have discovered that a qPCR "repeat-based" assay comprising one primer that specifically hybridizes to a common sequence in the genome, e.g. a repeat sequence, and another primer that binds to the primer binding site in the adaptor, measured an 8-fold increase in genome equivalents compared to methods using just the adaptor specific primer (present on both ends of the cfDNA clone). The number of genome equivalents measured by the repeat-based assays provides a more consistent library-to-library performance and a better alignment between qPCR estimates of genome equivalents and bioinformatically counted tag equivalents in sequencing runs.

Illustrative examples of repeats suitable for use in the repeat-based genome equivalent assays contemplated herein include, but are not limited to: short interspersed nuclear elements (SINEs), e.g., Alu repeats; long interspersed nuclear elements (LINEs), e.g., LINE1, LINE2, LINE3; microsatellite repeat elements, e.g., short tandem repeats (STRs), simple sequence repeats (SSRs); and mammalian-wide interspersed repeats (MIRs).

In one embodiment, the repeat is an Alu repeat.

4. Quantitative Genetic Analysis

In various embodiments, a method for genetic analysis of genomic DNA, e.g., genomic cellular or cfDNA, comprises quantitative genetic analysis of one or more target genetic loci of the DNA library clones. Quantitative genetic analysis comprises one or more of, or all of, the following steps: capturing DNA clones comprising a target genetic locus; amplification of the captured targeted genetic locus; sequencing of the amplified captured targeted genetic locus; and bioinformatic analysis of the resulting sequence reads. As used herein, the terms "DNA library clone" refer to a DNA library fragment wherein the combination of the adaptor and the genomic DNA fragment result in a unique DNA sequence (e.g., a DNA sequence that can be distinguished from that of another DNA library clone).

(a) Capture of Target Genetic Locus

The present invention contemplates, in part, a capture probe module designed to retain the efficiency and reliability of larger probes but that minimizes uninformative sequence generation in a genomic DNA library that comprises smaller DNA fragments, e.g., a cfDNA clone library. A "capture probe" or "capture probe module" as used herein, are used interchangeably and refer to a polynucleotide that comprises a capture probe sequence and a tail sequence. In particular embodiments, the capture probe module sequence or a portion thereof serves as a primer binding site for one or more sequencing primers.

In particular embodiments, a capture probe module comprises a capture probe. As used herein a "capture probe" refers to a region capable of hybridizing to a specific DNA target region. In some embodiments, the capture probes are used with genomic DNA library constructed from cellular DNA. In particular embodiments, the capture probes are used with genomic DNA library constructed from cfDNA. Because the average size of cfDNA is about 150 to about 170 bp and is highly fragmented, certain embodiments are directed compositions and methods contemplated herein comprise the use of high density and relatively short capture probes to interrogate DNA target regions of interest. In some embodiments, the capture probes are capable of hybridizing to DNA target regions that are distributed across all chromosomal segments at a uniform density. A set of such capture probes is referred to herein as "chromosomal stability probes." Chromosomal stability probes are used to interrogate copy number variations on a genome-wide scale in order to provide a genome-wise measurement of chromosomal copy number (e.g., chromosomal ploidy).

One particular concern with using high density capture probes is that generally capture probes are designed using specific "sequence rules." For example, regions of redundant sequence or that exhibit extreme base composition biases are generally excluded in designing capture probes. However, the present inventors have discovered that the lack of flexibility in capture probe design rules does not substantially impact probe performance. In contrast, capture probes chosen strictly by positional constraint provided on-target sequence information; exhibit very little off-target and unmappable read capture; and yield uniform, useful, on-target reads with only few exceptions. Moreover, the high redundancy at close probe spacing more than compensates for occasional poor-performing capture probes.

In particular embodiments, a target region is targeted by a plurality of capture probes, wherein any two or more capture probes are designed to bind to the target region within 10 nucleotides of each other, within 15 nucleotides of each other, within 20 nucleotides of each other, within 25 nucleotides of each other, within 30 nucleotides of each other, within 35 nucleotides of each other, within 40 nucleotides of each other, within 45 nucleotides of each other, or within 50 nucleotides or more of each other, as well as all intervening nucleotide lengths.

In one embodiment, the capture probe is about 25 nucleotides, about 26 nucleotides, about 27 nucleotides, about 28 nucleotides, about 29 nucleotides, about 30 nucleotides, about 31 nucleotides, about 32 nucleotides, about 33 nucleotides, about 34 nucleotides, about 35 nucleotides, about 36 nucleotides, about 37 nucleotides, about 38 nucleotides, about 39 nucleotides, about 40 nucleotides, about 41 nucleotides, about 42 nucleotides, about 43 nucleotides, about 44 nucleotides, or about 45 nucleotides.

In one embodiment, the capture probe is about 100 nucleotides, about 200 nucleotides, about 300 nucleotides, about 400 nucleotides, or about 100 nucleotides. In another embodiment, the capture probe is from about 100 nucleotides to about 500 nucleotides, about 200 nucleotides to about 500 nucleotides, about 300 nucleotides to about 500 nucleotides, or about 400 nucleotides to about 500 nucleotides, or any intervening range thereof.

In a particular embodiment, the capture probe is 60 nucleotides. In another embodiment, the capture probe is substantially smaller than 60 nucleotides but hybridizes comparably, as well as, or better than a 60 nucleotide capture probe targeting the same DNA target region. In a certain embodiment, the capture probe is 40 nucleotides.

In certain embodiments, a capture probe module comprises a tail sequence. As used herein, the term "tail sequence" refers to a polynucleotide at the 5' end of the capture probe module, which in particular embodiments can serve as a primer binding site. In particular embodiments, a sequencing primer binds to the primer binding site in the tail region.

In particular embodiments, the tail sequence is about 5 to about 100 nucleotides, about 10 to about 100 nucleotides, about 5 to about 75 nucleotides, about 5 to about 50 nucleotides, about 5 to about 25 nucleotides, or about 5 to about 20 nucleotides. In certain embodiments, the third region is from about 10 to about 50 nucleotides, about 15 to about 40 nucleotides, about 20 to about 30 nucleotides or about 20 nucleotides, or any intervening number of nucleotides.

In particular embodiments, the tail sequence is about 30 nucleotides, about 31 nucleotides, about 32 nucleotides, about 33 nucleotides, about 34 nucleotides, about 35 nucleotides, about 36 nucleotides, about 37 nucleotides, about 38 nucleotides, about 39 nucleotides, or about 40 nucleotides.

In various embodiments, the capture probe module comprises a specific member of a binding pair to enable isolation and/or purification of one or more captured fragments of a tagged and or amplified genomic DNA library (e.g., a cellular or cfDNA library) that hybridizes to the capture probe. In particular embodiments, the capture probe module is conjugate to biotin or another suitable hapten, e.g., dinitrophenol, digoxigenin.

In various embodiments, the capture probe module is hybridized to a tagged and optionally amplified DNA library to form a complex. In some embodiments, the multifunctional capture probe module substantially hybridizes to a specific genomic target region in the DNA library.

Hybridization or hybridizing conditions can include any reaction conditions where two nucleotide sequences form a stable complex; for example, the tagged DNA library and capture probe module forming a stable tagged DNA library-capture probe module complex. Such reaction conditions are well known in the art and those of skill in the art will appreciated that such conditions can be modified as appropriate, e.g., decreased annealing temperatures with shorter length capture probes, and within the scope of the present invention. Substantial hybridization can occur when the second region of the capture probe complex exhibits 100%, 99%, 98%, 97%, 96%, 95%, 94%, 93%, 92% 91%, 90%, 89%, 88%, 85%, 80%, 75%, or 70% sequence identity, homology or complementarity to a region of the tagged DNA library.

In particular embodiments, the capture probe is about 40 nucleotides and has an optimal annealing temperature of about 44° C. to about 47° C.

In certain embodiments, the methods contemplated herein comprise isolating a tagged cfDNA library-capture probe module complex. In particular embodiments, methods for isolating DNA complexes are well known to those skilled in the art and any methods deemed appropriate by one of skill in the art can be employed with the methods of the present invention (Ausubel et al., *Current Protocols in Molecular Biology*, 2007-2012). In particular embodiments, the complexes are isolated using biotin-streptavidin isolation techniques.

In particular embodiments, removal of the single stranded 3'-ends from the isolated tagged DNA library fragments-capture probe module complex is contemplated. In certain embodiments, the methods comprise 3'-5' exonuclease enzymatic processing of the isolated tagged DNA library-multifunctional capture probe module complex to remove the single stranded 3' ends.

In certain other embodiments, the methods comprise performing 5'-3' DNA polymerase extension of multifunctional capture probe utilizing the isolated tagged DNA library fragments as template.

In certain other embodiments, the methods comprise creating a hybrid capture probe-isolated tagged DNA target molecule, e.g., a tagged cfDNA target molecule or a tagged cellular DNA target molecule, through the concerted action of a 5' FLAP endonuclease, DNA polymerization and nick closure by a DNA ligase.

A variety of enzymes can be employed for the 3'-5' exonuclease enzymatic processing of the isolated tagged DNA library-multifunctional capture probe module complex. Illustrative examples of suitable enzymes, which exhibit 3'-5' exonuclease enzymatic activity, that can be employed in particular embodiments include, but are not limited to: T4 or Exonucleases I, III, V (See also, Shevelev I V, Hübscher U., *Nat Rev Mol Cell Biol.* 3(5):364-76 (2002)). In particular embodiments, the enzyme comprising 3'-5' exonuclease activity is T4 polymerase. In particular embodiments, an enzyme which exhibits 3'-5' exonuclease enzymatic activity and is capable of primer template extension can be employed, including for example T4 or Exonucleases I, III, V. Id.

In some embodiments, the methods contemplated herein comprise performing sequencing and/or PCR on the 3'-5' exonuclease enzymatically processed complex discussed supra and elsewhere herein. In particular embodiments, a tail portion of a capture probe molecule is copied in order to generate a hybrid nucleic acid molecule. In one embodiment, the hybrid nucleic acid molecule generated comprises the target region capable of hybridizing to the capture probe module and the complement of the capture probe module tail sequence.

In a particular embodiment, genetic analysis comprises a) hybridizing one or more capture probe modules to one or more target genetic loci in a plurality of genomic DNA library clones to form one or more capture probe module-DNA library clone complexes; b) isolating the one or more capture probe module-DNA library clone complexes from a); c) enzymatically processing the one or more isolated capture probe module-DNA library clone complexes from step b); d) performing PCR on the enzymatically processed complex from c) wherein the tail portion of the capture probe molecule is copied in order to generate amplified hybrid nucleic acid molecules, wherein the amplified hybrid nucleic acid molecules comprise a target sequence in the target genomic locus capable of hybridizing to the capture probe and the complement of the capture probe module tail sequence; and e) performing quantitative genetic analysis on the amplified hybrid nucleic acid molecules from d).

In a particular embodiment, methods for determining copy number of a specific target genetic locus are contemplated comprising: a) hybridizing one or more capture probe modules to one or more target genetic loci in a plurality of DNA library clones to form one or more capture probe module-DNA library clone complexes; b) isolating the one or more capture probe module-DNA library clone complexes from a); c) enzymatically processing the one or more isolated capture probe module-DNA library clone complexes from step b); d) performing PCR on the enzymatically processed complex from c) wherein the tail portion of the capture probe molecule is copied in order to generate amplified hybrid nucleic acid molecules, wherein the amplified hybrid nucleic acid molecules comprise a target sequence in the target genetic locus capable of hybridizing to the capture probe and the complement of the capture probe module tail sequence; e) performing PCR amplification of the amplified hybrid nucleic acid molecules in d); and f) quantitating the PCR reaction in e), wherein the quantitation allows for a determination of copy number of the specific target region.

In one embodiment, the enzymatic processing of step c) comprises performing 3'-5' exonuclease enzymatic processing on the one or more capture probe module-DNA library clone complexes from b) using an enzyme with 3'-5' exonuclease activity to remove the single stranded 3' ends; creating one or more hybrid capture probe module-cfDNA library clone molecules through the concerted action of a 5' FLAP endonuclease, DNA polymerization and nick closure by a DNA ligase; or performing 5'-3' DNA polymerase extension of the capture probe using the isolated DNA clone in the complex as a template.

In one embodiment, the enzymatic processing of step c) comprises performing 5'-3' DNA polymerase extension of the capture probe using the isolated DNA clone in the complex as a template.

In particular embodiments, PCR can be performed using any standard PCR reaction conditions well known to those of skill in the art. In certain embodiments, the PCR reaction in e) employs two PCR primers. In one embodiment, the PCR reaction in e) employs a first PCR primer that hybridizes to a repeat within the target genetic locus. In a particular embodiment, the PCR reaction in e) employs a second PCR primer that hybridizes to the hybrid nucleic acid molecules at the target genetic locus/tail junction. In certain embodiments, the PCR reaction in e) employs a first PCR primer that hybridizes to the target genetic locus and a second PCR primer hybridizes to the amplified hybrid nucleic acid molecules at the target genetic locus/tail junction. In particular embodiments, the second primer hybridizes to the target genetic locus/tail junction such that at least one or more nucleotides of the primer hybridize to the target genetic locus and at least one or more nucleotides of the primer hybridize to the tail sequence.

In certain embodiments, the amplified hybrid nucleic acid molecules obtained from step e) are sequenced and the sequences aligned horizontally, i.e., aligned to one another but not aligned to a reference sequence. In particular embodiments, steps a) through e) are repeated one or more times with one or more capture probe modules. The capture probe modules can be the same or different and designed to target either cfDNA strand of a target genetic locus. In some embodiments, when the capture probes are different, they hybridize at overlapping or adjacent target sequences within a target genetic locus in the tagged cfDNA clone library. In one embodiment, a high density capture probe strategy is used wherein a plurality of capture probes hybridize to a target genetic locus, and wherein each of the plurality of capture probes hybridizes to the target genetic locus within about 5, 10, 15, 20, 25, 30, 35, 40, 45, 50, 100, 200 bp or more of any other capture probe that hybridizes to the target genetic locus in a tagged DNA clone library, including all intervening distances.

In some embodiments, the method can be performed using two capture probe modules per target genetic locus, wherein one hybridizes to the "Watson" strand (non-coding or template strand) upstream of the target region and one hybridizes to the "Crick" strand (coding or non-template strand) downstream of the target region.

In particular embodiments, the methods contemplated herein can further be performed multiple times with any number of capture probe modules, for example 2, 3, 4, 5, 6, 7, 8, 9, or 10 or more capture probe modules per target genetic locus any number of which hybridize to the Watson or Crick strand in any combination. In some embodiments, the sequences obtained can be aligned to one another in order to identify any of a number of differences.

In certain embodiments, a plurality of target genetic loci are interrogated, e.g., 100, 200, 300, 400, 500, 600, 700, 800, 900, 1000, 1500, 2000, 2500, 3000, 3500, 4000, 4500, 5000, 10000, 50000, 100000, 500000 or more in a single reaction, using one or more capture probe modules.

(b) Sequencing

In particular embodiments, the quantitative genetic analysis comprises sequencing a plurality of hybrid nucleic acid molecules, as discussed elsewhere herein, supra, to generate sufficient sequencing depths to obtain a plurality of unique sequencing reads. The terms "unique reads" or "unique genomic sequences" (UGS) are used interchangeably herein and are identified by grouping individual redundant reads together into a "family." Redundant reads are sequence reads that share an identical UMIE (e.g., share the same read code and the same DNA sequence start position within genomic sequence) and are derived from a single attachment event and are therefore amplification-derived "siblings" of one another. A single consensus representative of a family of redundant reads is carried forward as a unique read or UGS. Each unique read or UGS is considered a unique attachment event. The sum of unique reads corresponding to a particular capture probe is referred to as the "raw genomic depth" (RGD) for that particular capture probe. Each capture probe yields a set of unique reads that are computationally distilled from total reads by grouping into families. The unique reads for a given sample (e.g., raw genomic depth for a sample) are then computed as the average of all the unique reads observed on a probe-by-probe basis. Unique reads are important because each unique read must be derived from a unique genomic DNA clone. Each unique read represents the input and analysis of a haploid equivalent of genomic DNA. The sum of unique reads is the sum of haploid genomes analyzed. The number of genomes analyzed, in turn, defines the sensitivity of the sequencing assay. By way of a non-limiting example, if the average unique read count is 100 genome equivalents, then that particular assay has a sensitivity of being able to detect one mutant read in 100, or 1%. Any observation less than this is not defensible.

Cases where there is an obvious copy number change (e.g., instances of noisy probes) are excluded from the data set used to compute the sample average. Herein, a "noisy probe" refers to a probe that captures a highly variable number of unique reads among a large set identical samples (e.g., a highly variable number of unique reads among 12-16 sample replicates). In some embodiments, the number of unique reads associated with a noisy probe is increased compared to the average number of unique reads for the sample by 50% or more. In some embodiments, the number of unique reads associated with a noisy probe is decreased compared to the average number of unique reads for the sample by 50% or more. In some embodiments, about 2% to about 4% of probes used in a particular analysis are identified as noisy probes and are excluded from calculations to determine the average number of unique reads for a given sample.

In some embodiments, sequencing reads are identified as either "on-target reads" or "off-target reads." On-target reads possess a genomic DNA sequence that maps within the vicinity of a capture probe used to create the genomic library. In some embodiments, where each genomic sequence is physically linked to a specific capture probe and where the sequence of the genomic segment and capture probe are both determined as a unified piece of information, an on-target read is defined as any genomic sequence whose starting coordinate maps within 400 bp, and more generally within 200 bp of the 3' end of the corresponding capture probe. Off-target reads are defined as having genomic sequence that aligns to the reference genome at a location ≥500 base pairs (and more often mapping to entirely different chromosomes) relative to the capture probe.

In particular embodiments, the quantitative genetic analysis comprises multiplex sequencing of hybrid nucleic acid molecules derived from a plurality of samples.

In various embodiments, the quantitative genetic analysis comprises obtaining one or more or a plurality of tagged DNA library clones, each clone comprising a first DNA sequence and a second DNA sequence, wherein the first DNA sequence comprises a sequence in a targeted genetic locus and the second DNA sequence comprises a capture probe sequence; performing a paired end sequencing reaction on the one or more clones and obtaining one or more sequencing reads or performing a sequencing reaction on the one or more clones in which a single long sequencing read of greater than about 100, 200, 300, 400, 500 or more nucleotides is obtained, wherein the read is sufficient to identify both the first DNA sequence and the second DNA sequence; and ordering or clustering the sequencing reads of the one or more clones according to the probe sequences of the sequencing reads.

(c) Bioinformatics Analysis

In various embodiments, the quantitative genetic analysis further comprises bioinformatic analysis of the sequencing reads. Bioinformatic analysis excludes any purely mental analysis performed in the absence of a composition or method for sequencing. In certain embodiments, bioinformatics analysis includes, but is not limited to: sequence alignments; genome equivalents analysis; single nucleotide variant (SNV) analysis; gene copy number variation (CNV) analysis; measurement of chromosomal copy number; and detection of genetic lesions. In particular embodiments, bioinformatics analysis is useful to quantify the number of genome equivalents analyzed in the cfDNA clone library; to detect the genetic state of a target genetic locus; to detect genetic lesions in a target genetic locus; and to measure copy number fluctuations within a target genetic locus.

Sequence alignments may be performed between the sequence reads and one or more human reference DNA sequences. In particular embodiments, sequencing alignments can be used to detect genetic lesions in a target genetic locus including, but not limited to detection of a nucleotide transition or transversion, a nucleotide insertion or deletion, a genomic rearrangement, a change in copy number, or a gene fusion. Detection of genetic lesions that are causal or prognostic indicators may be useful in the diagnosis, prognosis, treatment, and/or monitoring of a particular genetic condition or disease.

Also contemplated herein, are methods for sequence alignment analysis that can be performed without the need for alignment to a reference sequence, referred to herein as horizontal sequence analysis. Such analysis can be performed on any sequences generated by the methods contemplated herein or any other methods. In particular embodiments, the sequence analysis comprises performing sequence alignments on the reads obtained by the methods contemplated herein.

In one embodiment, the genome equivalents in a cfDNA clone library are determined using bioinformatics-based counting after sequencing is performed. Each sequencing read is associated with a particular capture probe, and the collection of reads assigned to each capture probe is parsed into groups. Within a group, sets of individual reads share the same read code and the same DNA sequence start position within genomic sequence. These individual reads are grouped into a "family" and a single consensus representative of this family is carried forward as a "unique read."

All of the individual reads that constituted a family are derived from a single attachment event and thus, they are amplification-derived "siblings" of one another. Each unique read is considered a unique attachment event and the sum of unique reads is considered equivalent to the number of genome equivalents analyzed.

As the number of unique clones approaches the total number of possible sequence combinations, probability dictates that the same code and start site combinations will be created by independent events and that these independent events will be inappropriately grouped within single families. The net result will be an underestimate of genome equivalents analyzed, and rare mutant reads may be discarded as sequencing errors because they overlap with wild-type reads bearing the same identifiers.

In particular embodiments, to provide an accurate analysis for cfDNA clone libraries, the number of genome equivalents analyzed is about 1/10, about 1/12, about 1/14, about 1/16, about 1/18, about 1/20, about 1/25 or less the number of possible unique clones. It should be understood that the procedure outlined above is merely illustrative and not limiting.

In some embodiments, the number of genome equivalents to be analyzed may need to be increased. To expand the depth of genome equivalents, at least two solutions are contemplated. The first solution is to use more than one adaptor set per sample. By combining adaptors, it is possible to multiplicatively expand the total number of possible clones and therefore, expand the comfortable limits of genomic input. The second solution is to expand the read code by 1, 2, 3, 4, or 5, or more bases. The number of possible read codes that differ by at least 2 bases from every other read code scales as $4^{(n-1)}$ where n is the number of bases within a read code. Thus, in a non-limiting example, if a read code is 5 nucleotides and $4^{(5-1)}=256$; therefore, the inclusion of additional bases expands the available repertoire by a factor of four for each additional base.

In one embodiment, quantitative genetic analysis comprises bioinformatic analysis of sequencing reads to identify rare single nucleotide variants (SNV).

Next-generation sequencing has an inherent error rate of roughly 0.02-0.02%, meaning that anywhere from 1/200 to 1/500 base calls are incorrect. To detect variants and other mutations that occur at frequencies lower than this, for example at frequencies of 1 per 1000 sequences, it is necessary to invoke molecular annotation strategies. By way of a non-limiting example, analysis of 5000 unique molecules using targeted sequence capture technology would generate—at sufficient sequencing depths of >50,000 reads—a collection of 5000 unique reads, with each unique read belonging to a "family" of reads that all possess the same read code. A SNV that occurs within a family is a candidate for being a rare variant. When this same variant is observed in more than one family, it becomes a very strong candidate for being a rare variant that exists within the starting sample. In contrast, variants that occur sporadically within families are likely to be sequencing errors and variants that occur within one and only one family are either rare or the result of a base alteration that occurred ex vivo (e.g., oxidation of a DNA base or PCR-introduced errors).

In one embodiment, the methods of detecting SNVs comprise introducing 10-fold more genomic input (genomes or genome equivalents) as the desired target sensitivity of the assay. In one non-limiting example, if the desired sensitivity is 2% (2 in 100), then the experimental target is an input of 2000 genomes.

In particular embodiments, bioinformatics analysis of sequencing data is used to detect or identify SNV associated with a genetic state, condition or disease, genetic mosaicism, fetal testing, paternity testing, predicting response to drug treatment, diagnosing or monitoring a medical condition, microbiome profiling, pathogen screening, and monitoring organ transplants.

In various embodiments, a method for copy number determination analysis is provided comprising obtaining one or more or a plurality of clones, each clone comprising a first DNA sequence and a second DNA sequence, wherein the first DNA sequence comprises a sequence in a targeted genetic locus and the second DNA sequence comprises a capture probe sequence. In related embodiments, a paired end sequencing reaction on the one or more clones is performed and one or more sequencing reads are obtained. In another embodiment, a sequencing reaction on the one or more clones is performed in which a single long sequencing read of greater than about 100 nucleotides is obtained, wherein the read is sufficient to identify both the first DNA sequence and the second DNA sequence. The sequencing reads of the one or more clones can be ordered or clustered according to the probe sequence of the sequencing reads.

Copy number analyses include, but are not limited to, analyses that examine the number of copies of a particular gene or mutation that occurs in a given genomic DNA sample and can further include quantitative determination of the number of copies of a given gene or sequence differences in a given sample. In particular embodiments, copy number analysis is used to detect or identify gene amplification associated with genetic states, conditions, or diseases, fetal testing, genetic mosaicism, paternity testing, predicting response to drug treatment, diagnosing or monitoring a medical condition, microbiome profiling, pathogen screening, and monitoring organ transplants.

In some embodiments, copy number analysis is used to measure chromosomal instability. In such embodiments, sets of capture probes that comprise chromosomal stability probes are used to determine copy number variations at a uniform density across all sets of chromosomes. Copy number analyses are performed for each chromosomal stability probe and the chromosomal stability probes are then ordered according to their chromosomal target. This allows for visualization of copy number losses or gains across the genome and can serve as a measure of chromosomal stability.

In particular embodiments, bioinformatics analysis of sequencing data is used to detect or identify one or more sequences or genetic lesions in a target locus including, but not limited to detection of a nucleotide transition or transversion, a nucleotide insertion or deletion, a genomic rearrangement, a change in copy number, or a gene fusion. Detection of genetic lesions that are causal or prognostic indicators may be useful in the diagnosis, prognosis, treatment, and/or monitoring of a particular genetic condition or disease. In one embodiment, genetic lesions are associated with genetic states, conditions, or diseases, fetal testing, genetic mosaicism, paternity testing, predicting response to drug treatment, diagnosing or monitoring a medical condition, microbiome profiling, pathogen screening, and monitoring organ transplants.

D. Clinical Applications of Quantitative CNL Assays

In various embodiments, the present invention contemplates a method of detecting, identifying, predicting, diagnosing, or monitoring a condition or disease in a subject by detecting a mutational change, SNP, translocation, inver-

E. Clinical Applications of Quantitative Genetic Analysis

In various embodiments, the present invention contemplates a method of detecting, identifying, predicting, diagnosing, or monitoring a condition or disease in a subject.

In particular embodiments, a method of detecting, identifying, predicting, diagnosing, or monitoring a genetic state, condition or disease in a subject comprises performing a quantitative genetic analysis of one or more target genetic loci in a DNA clone library to detect or identify a change in the sequence at the one or more target genetic loci. In some embodiments, the change is a change in copy number.

In one embodiment, a method of detecting, identifying, predicting, diagnosing, or monitoring a genetic state, condition or disease comprises isolating or obtaining cellular DNA or cfDNA from a biological sample of a subject; treating the cellular DNA or cfDNA with one or more end-repair enzymes to generate end-repaired DNA; attaching one or more adaptors to each end of the end-repaired DNA to generate a genomic DNA library; amplifying the DNA library to generate a DNA clone library; determining the number of genome equivalents in the DNA clone library; and performing a quantitative genetic analysis of one or more target genetic loci in a DNA clone library to detect or identify a change in the sequence, e.g., an SNP, a translocation, an inversion, a deletion, or a change in copy number at of the one or more target genetic loci.

In particular embodiments, a method of detecting, identifying, predicting, diagnosing, or monitoring a genetic state, or genetic condition or disease selected from the group consisting of: genetic diseases; genetic mosaicism; fetal testing; paternity testing; paternity testing; predicting response to drug treatment; diagnosing or monitoring a medical condition; microbiome profiling; pathogen screening; and organ transplant monitoring comprising isolating or obtaining genomic DNA from a biological sample of a subject; treating the DNA with one or more end-repair enzymes to generate end-repaired DNA; attaching one or more adaptors to each end of the end-repaired DNA to generate a genomic DNA library; amplifying the genomic DNA library to generate a DNA clone library; determining the number of genome equivalents in the DNA clone library; and performing a quantitative genetic analysis of one or more target genetic loci in a DNA clone library to detect or identify a nucleotide transition or transversion, a nucleotide insertion or deletion, a genomic rearrangement, a change in copy number, or a gene fusion in the sequence at the one or more target genetic loci.

Illustrative examples of genetic diseases that can be detected, identified, predicted, diagnosed, or monitored with the compositions and methods contemplated herein include, but are not limited to cancer, Alzheimer's disease (APOE1), Charcot-Marie-Tooth disease, Leber hereditary optic neuropathy (LHON), Angelman syndrome (UBE3A, ubiquitin-protein ligase E3A), Prader-Willi syndrome (region in chromosome 15), β-Thalassaemia (HBB, β-Globin), Gaucher disease (type I) (GBA, Glucocerebrosidase), Cystic fibrosis (CFTR Epithelial chloride channel), Sickle cell disease (HBB, β-Globin), Tay-Sachs disease (HEXA, Hexosaminidase A), Phenylketonuria (PAH, Phenylalanine hydrolyase), Familial hypercholesterolaemia (LDLR, Low density lipoprotein receptor), Adult polycystic kidney disease (PKD1, Polycystin), Huntington disease (HDD, Huntingtin), Neurofibromatosis type I (NF1, NF1 tumour suppressor gene), Myotonic dystrophy (DM, Myotonin), Tuberous sclerosis (TSC1, Tuberin), Achondroplasia (FGFR3, Fibroblast growth factor receptor), Fragile X syndrome (FMR1, RNA-binding protein), Duchenne muscular dystrophy (DMD, Dystrophin), Haemophilia A (F8C, Blood coagulation factor VIII), Lesch-Nyhan syndrome (HPRT1, Hypoxanthine guanine ribosyltransferase 1), and Adrenoleukodystrophy (ABCD1).

Illustrative examples of cancers that can be detected, identified, predicted, diagnosed, or monitored with the compositions and methods contemplated herein include, but are not limited to: B cell cancer, e.g., multiple myeloma, melanomas, breast cancer, lung cancer (such as non-small cell lung carcinoma or NSCLC), bronchus cancer, colorectal cancer, prostate cancer, pancreatic cancer, stomach cancer, ovarian cancer, urinary bladder cancer, brain or central nervous system cancer, peripheral nervous system cancer, esophageal cancer, cervical cancer, uterine or endometrial cancer, cancer of the oral cavity or pharynx, liver cancer, kidney cancer, testicular cancer, biliary tract cancer, small bowel or appendix cancer, salivary gland cancer, thyroid gland cancer, adrenal gland cancer, osteosarcoma, chondrosarcoma, cancer of hematological tissues, adenocarcinomas, inflammatory myofibroblastic tumors, gastrointestinal stromal tumor (GIST), colon cancer, multiple myeloma (MM), myelodysplastic syndrome (MDS), myeloproliferative disorder (MPD), acute lymphocytic leukemia (ALL), acute myelocytic leukemia (AML), chronic myelocytic leukemia (CML), chronic lymphocytic leukemia (CLL), polycythemia Vera, Hodgkin lymphoma, non-Hodgkin lymphoma (NHL), soft-tissue sarcoma, fibrosarcoma, myxosarcoma, liposarcoma, osteogenic sarcoma, chordoma, angiosarcoma, endotheliosarcoma, lymphangiosarcoma, lymphangioendotheliosarcoma, synovioma, mesothelioma, Ewing's tumor, leiomyosarcoma, rhabdomyosarcoma, squamous cell carcinoma, basal cell carcinoma, adenocarcinoma, sweat gland carcinoma, sebaceous gland carcinoma, papillary carcinoma, papillary adenocarcinomas, medullary carcinoma, bronchogenic carcinoma, renal cell carcinoma, hepatoma, bile duct carcinoma, choriocarcinoma, seminoma, embryonal carcinoma, Wilms' tumor, bladder carcinoma, epithelial carcinoma, glioma, astrocytoma, medulloblastoma, craniopharyngioma, ependymoma, pinealoma, hemangioblastoma, acoustic neuroma, oligodendroglioma, meningioma, neuroblastoma, retinoblastoma, follicular lymphoma, diffuse large B-cell lymphoma, mantle cell lymphoma, hepatocellular carcinoma, thyroid cancer, gastric cancer, head and neck cancer, small cell cancers, essential thrombocythemia, agnogenic myeloid metaplasia, hypereosinophilic syndrome, systemic mastocytosis, familiar hypereosinophilia, chronic eosinophilic leukemia, neuroendocrine cancers, carcinoid tumors, and the like.

In one embodiment, the genetic lesion is a lesion annotated in the Cosmic database (the lesions and sequence data are available online and can be downloaded from the Cancer Gene Census section of the Cosmic website) or a lesion annotated in the Cancer Genome Atlas (the lesions and sequence data are available online and can be downloaded from The Cancer Genome Atlas website).

Illustrative examples of genes that harbor one or more genetic lesions associated with cancer that can be detected, identified, predicted, diagnosed, or monitored with the compositions and methods contemplated herein include, but are not limited to ABCB1, ABCC2, ABCC4, ABCG2, ABL1, ABL2, AKT1, AKT2, AKT3, ALDH4A1, ALK, APC, AR, ARAF, ARFRP1, ARID1A, ATM, ATR, AURKA, AURKB, BCL2, BCL2A1, BCL2L1, BCL2L2, BCL6, BRAF, BRCA1, BRCA2, C1orf144, CARD11, CBL, CCND1, CCND2, CCND3, CCNE1, CDH1, CDH2, CDH20, CDH5, CDK4, CDK6, CDK8, CDKN2A, CDKN2B, CDKN2C, CEBPA, CHEK1, CHEK2, CRKL, CRLF2, CTNNB1, CYP1B1, CYP2C19, CYP2C8, CYP2D6, CYP3A4, CYP3A5, DNMT3A, DOT1L, DPYD, EGFR, EPHA3, EPHA5, EPHA6, EPHA7, EPHB1, EPHB4, EPHB6, EPHX1, ERBB2, ERBB3, ERBB4, ERCC2, ERG, ESR1, ESR2, ETV1, ETV4, ETV5, ETV6, EWSR1, EZH2, FANCA, FBXW7, FCGR3A, FGFR1, FGFR2, FGFR3, FGFR4, FLT1, FLT3, FLT4, FOXP4, GATA1, GNA11, GNAQ, GNAS, GPR124, GSTP1, GUCY1A2, HOXA3, HRAS, HSP90AA1, IDH1, IDH2, IGF1R, IGF2R, IKBKE, IKZF1, INHBA, IRS2, ITPA, JAK1, JAK2, JAK3, JUN, KDR, KIT, KRAS, LRP1B, LRP2, LTK, MAN1B1, MAP2K1, MAP2K2, MAP2K4, MCL1, MDM2, MDM4, MEN1, MET, M1TF, MLH1, MLL, MPL, MRE11A, MSH2, MSH6, MTHFR, MTOR, MUTYH, MYC, MYCL1, MYCN, NF1, NF2, NKX2-1, NOTCH1, NPM1, NQO1, NRAS, NRP2, NTRK1, NTRK3, PAK3, PAX5, PDGFRA, PDGFRB, PIK3CA, PIK3R1, PKHD1, PLCG1, PRKDC, PTCH1, PTEN, PTPN11, PTPRD, RAF1, RARA, RB1, RET, RICTOR, RPTOR, RUNX1. SLC19A1, SLC22A2, SLCO1B3, SMAD2, SMAD3, SMAD4, SMARCA4, SMARCB1, SMO, SOD2, SOX10, SOX2, SRC, STK11, SULT1A1, TBX22, TET2, TGFBR2, TMPRSS2, TNFRSF14, TOP1, TP53, TPMT, TSC1, TSC2, TYMS, UGT1A1, UMPS, USP9X, VHL, and WT1.

In particular embodiments, the genetic lesion comprises a nucleotide transition or transversion, a nucleotide insertion or deletion, a genomic rearrangement, a change in copy number, or a gene fusion.

In one embodiment, the genetic lesion is a gene fusion that fuses the 3' coding region of the ALK gene to another gene.

In one embodiment, the genetic lesion is a gene fusion that fuses the 3' coding region of the ALK gene to the EML4 gene.

Illustrative examples of conditions suitable for fetal testing that can be detected, identified, predicted, diagnosed, or monitored with the compositions and methods contemplated herein include but are not limited to: Down Syndrome (Trisomy 21), Edwards Syndrome (Trisomy 18), Patau Syndrome (Trisomy 13), Klinefelter's Syndrome (XXY), Triple X syndrome, XYY syndrome, Trisomy 8, Trisomv 16, Turner Syndrome (XO), Robertsonian translocation, DiGeorge Syndrome and Wolf-Hirschhom Syndrome.

Illustrative examples of alleles suitable for paternity testing that can be detected, identified, predicted, diagnosed, or monitored with the compositions and methods contemplated herein include but are not limited to 16 or more of: D20S1082, D6S474, D12ATA63, D22S1045, D10S1248, D1S1677, D11S4463, D4S2364, D9S1122, D2S1776, D10S1425, D3S3053, D5S2500, D1S1627, D3S4529, D2S441, D17S974, D6S1017, D4S2408, D9S2157, Amelogenin, D17S1301, D1GATA113, D18S853, D20S482, and D14S1434.

Illustrative examples of genes suitable for predicting the response to drug treatment that can be detected, identified, predicted, diagnosed, or monitored with the compositions and methods contemplated herein include, but are not limited to, one or more of the following genes: ABCB1 (ATP-binding cassette, sub-family B (MDR/TAP), member 1), ACE (angiotensin I converting enzyme), ADH1A (alcohol dehydrogenase 1A (class I), alpha polypeptide), ADH1B (alcohol dehydrogenase IB (class I), beta polypeptide), ADH1C (alcohol dehydrogenase 1C (class I), gamma polypeptide), ADRB1 (adrenergic, beta-1-, receptor), ADRB2 (adrenergic, beta-2-, receptor, surface), AHR (aryl hydrocarbon receptor), ALDH1A1 (aldehyde dehydrogenase 1 family, member A1), ALOX5 (arachidonate 5-lipoxygenase), BRCA1 (breast cancer 1, early onset), COMT (catechol-O-methyltransferase), CYP2A6 (cytochrome P450, family 2, subfamily A, polypeptide 6), CYP2B6 (cytochrome P450, family 2, subfamily B, polypeptide 6), CYP2C9 (cytochrome P450, family 2, subfamily C, polypeptide 9), CYP2C19 (cytochrome P450, family 2, subfamily C, polypeptide 19), CYP2D6 (cytochrome P450, family 2, subfamily D, polypeptide 6), CYP2J2 (cytochrome P450, family 2, subfamily J, polypeptide 2), CYP3A4 (cytochrome P450, family 3, subfamily A, polypeptide 4), CYP3A5 (cytochrome P450, family 3, subfamily A, polypeptide 5), DPYD (dihydropyrimidine dehydrogenase), DRD2 (dopamine receptor D2), F5 (coagulation factor V), GSTP1 (glutathione S-transferase pi), HMGCR (3-hydroxy-3-methylglutaryl-Coenzyme A reductase), KCNH2 (potassium voltage-gated channel, subfamily H (eag-related), member 2), KCNJ11 (potassium inwardly-rectifying channel, subfamily J, member 11), MTHFR (5,10-methylenetetrahydrofolate reductase (NADPH)), NQO1 (NAD(P)H dehydrogenase, quinone 1), P2RY1 (purinergic receptor P2Y, G-protein coupled, 1), P2RY12 (purinergic receptor P2Y, G-protein coupled, 12), PTGIS (prostaglandin I2 (prostacyclin) synthase), SCN5A (sodium channel, voltage-gated, type V, alpha (long QT syndrome 3)), SLC19A1 (solute carrier family 19 (folate transporter), member 1), SLCO1B1 (solute carrier organic anion transporter family, member 1B1), SULT1A1 (sulfotransferase family, cytosolic, 1A, phenol-preferring, member 1), TPMT (thiopurine S-methyltransferase), TYMS (thymidylate synthetase), UGT1A1 (UDP glucuronosyltransferase 1 family, polypeptide A1), VDR (vitamin D (1,25-dihydroxyvitamin D3) receptor), VKORC1 (vitamin K epoxide reductase complex, subunit 1).

Illustrative examples of medical conditions that can be detected, identified, predicted, diagnosed, or monitored with the compositions and methods contemplated herein include, but are not limited to: stroke, transient ischemic attack, traumatic brain injury, heart disease, heart attack, angina, atherosclerosis, and high blood pressure.

Illustrative examples of pathogens that can be screened for with the compositions and methods contemplated herein include, but are not limited to: bacteria fungi, and viruses.

Illustrative examples of bacterial species that can be screened for with the compositions and methods contemplated herein include, but are not limited to: a *Mycobacterium* spp., a *Pneumococcus* spp., an *Escherichia* spp., a *Campylobacter* spp., a *Corynebacterium* spp., a *Clostridium* spp., a *Streptococcus* spp., a *Staphylococcus* spp., a *Pseudomonas* spp., a *Shigella* spp., a *Treponema* spp., or a *Salmonella* spp.

Illustrative examples of fungal species that can be screened for with the compositions and methods contemplated herein include, but are not limited to: an *Aspergillis* spp., a *Blastomyces* spp., a *Candida* spp., a *Coccicioides* spp., a *Cryptococcus* spp., dermatophytes, a *Tinea* spp., a *Trichophyton* spp., a *Microsporum* spp., a *Fusarium* spp., a *Histoplasma* spp., a *Mucoromycotina* spp., a *Pneumocystis* spp., a *Sporothrix* spp., an *Exserophilum* spp., or a *Cladosporium* spp.

Illustrative examples of viruses that can be screened for with the compositions and methods contemplated herein include, but are not limited to: Influenza A such as H1N1, H1N2, H3N2 and H5N1 (bird flu), Influenza B, Influenza C virus, Hepatitis A virus. Hepatitis B virus, Hepatitis C virus. Hepatitis D virus, Hepatitis E virus. Rotavirus, any virus of the Norwalk virus group, enteric adenoviruses, parvovirus, Dengue fever virus. Monkey pox, Mononegavirales, Lyssavirus such as rabies virus, Lagos bat virus, Mokola virus, Duvenhage virus, European bat virus 1 & 2 and Australian bat virus, Ephemerovirus, Vesiculovirus, Vesicular Stomatitis Virus (VSV), Herpesviruses such as Herpes simplex virus types 1 and 2, varicella zoster, cytomegalovirus, Epstein-Bar virus (EBV), human herpesviruses (HHV), human herpesvirus type 6 and 8, Moloney murine leukemia virus (M-MuLV), Moloney murine sarcoma virus (MoMSV), Harvey murine sarcoma virus (HaMuSV), murine mammary tumor virus (MuMTV), gibbon ape leukemia virus (GaLV), feline leukemia virus (FLV), spumavirus, Friend murine leukemia virus, Murine Stem Cell Virus (MSCV) and Rous Sarcoma Virus (RSV), HIV (human immunodeficiency virus; including HIV type 1, and HIV type 2), visna-maedi virus (VMV) virus, the caprine arthritis-encephalitis virus (CAEV), equine infectious anemia virus (EIAV), feline immunodeficiency virus (FIV), bovine immune deficiency virus (BIV), and simian immunodeficiency virus (SIV), papilloma virus, murine gammaherpesvirus, Arenaviruses such as Argentine hemorrhagic fever virus, Bolivian hemorrhagic fever virus, Sabia-associated hemorrhagic fever virus, Venezuelan hemorrhagic fever virus, Lassa fever virus, Machupo virus, Lymphocytic choriomeningitis virus (LCMV), Bunyaviridae such as Crimean-Congo hemorrhagic fever virus, Hantavirus, hemorrhagic fever with renal syndrome causing virus, Rift Valley fever virus, Filoviridae (filovirus) including Ebola hemorrhagic fever and Marburg hemorrhagic fever, Flaviviridae including Kaysanur Forest disease virus, Omsk hemorrhagic fever virus, Tick-borne encephalitis causing virus and Paramyxoviridae such as Hendra virus and Nipah virus, variola major and variola minor (smallpox), alphaviruses such as Venezuelan equine encephalitis virus, eastern equine encephalitis virus, western equine encephalitis virus, SARS-associated coronavirus (SARS-CoV), West Nile virus, and any encephaliltus causing virus.

Illustrative examples of genes suitable for monitoring an organ transplant in a transplant recipient that can be detected, identified, predicted, diagnosed, or monitored with the compositions and methods contemplated herein include, but are not limited to, one or more of the following genes: HLA-A, HLA-B, HLA-C, HLA-DR, HLA-DP, and HLA-DQ.

In particular embodiments, a bioinformatic analysis is used to quantify the number of genome equivalents analyzed in the cfDNA clone library; detect genetic variants in a target genetic locus; detect mutations within a target genetic locus; detect genetic fusions within a target genetic locus; or measure copy number fluctuations within a target genetic locus.

F. Companion Diagnostics

In various embodiments, a companion diagnostic for a genetic disease is provided, comprising: isolating or obtaining genomic DNA from a biological sample of a subject; treating the DNA with one or more end-repair enzymes to generate end-repaired DNA; attaching one or more adaptors to each end of the end-repaired DNA to generate a DNA library; amplifying the DNA library to generate a DNA clone library; determining the number of genome equivalents in the DNA clone library; and performing a quantitative genetic analysis of one or more biomarkers associated with the genetic disease in the DNA clone library, wherein detection of, or failure to detect, at least one of the one or more biomarkers indicates whether the subject should be treated for the genetic disease. In some embodiments, the DNA is cfDNA. In particular embodiments, the DNA is cellular DNA.

As used herein, the term "companion diagnostic" refers to a diagnostic test that is linked to a particular anti-cancer therapy. In a particular embodiment, the diagnostic methods comprise detection of genetic lesion in a biomarker associated with in a biological sample, thereby allowing for prompt identification of patients should or should not be treated with the anti-cancer therapy.

Anti-cancer therapy includes, but is not limited to surgery, radiation, chemotherapeutics, anti-cancer drugs, and immunomodulators.

Illustrative examples of anti-cancer drugs include, but are not limited to: alkylating agents such as thiotepa and cyclophosphamide (CYTOXAN™); alkyl sulfonates such as busulfan, improsulfan and piposulfan; aziridines such as benzodopa, carboquone, meturedopa, and uredopa; ethylenimines and methylamelamines including altretamine, triethylenemelamine, trietylenephosphoramide, triethylenethiophosphaoramide and trimethylolomelamine resume; nitrogen mustards such as chlorambucil, chlomaphazine, cholophosphamide, estramustine, ifosfamide, mechlorethamine, mechlorethamine oxide hydrochloride, melphalan, novembichin, phenesterine, prednimustine, trofosfamide, uracil mustard; nitrosureas such as carmustine, chlorozotocin, fotemustine, lomustine, nimustine, ranimustine; antibiotics such as aclacinomysins, actinomycin, authramycin, azaserine, bleomycins, cactinomycin, calicheamicin, carabicin, carminomycin, carzinophilin, chromomycins, dactinomycin, daunorubicin, detorubicin, 6-diazo-5-oxo-L-norleucine, doxorubicin and its pegylated formulations, epirubicin, esorubicin, idarubicin, marcellomycin, mitomycins, mycophenolic acid, nogalamycin, olivomycins, peplomycin, potfiromycin, puromycin, quelamycin, rodorubicin, streptonigrin, streptozocin, tubercidin, ubenimex, zinostatin, zorubicin; anti-metabolites such as methotrexate and 5-fluorouracil (5-FU); folic acid analogues such as denopterin, methotrexate, pteropterin, trimetrexate; purine analogs such as fludarabine, 6-mercaptopurine, thiamiprine, thioguanine; pyrimidine analogs such as ancitabine, azacitidine, 6-azauridine, carmofur, cytarabine, dideoxyuridine, doxifluridine, enocitabine, floxuridine, 5-FU; androgens such as calusterone, dromostanolone propionate, epitiostanol, mepitiostane, testolactone; anti-adrenals such as aminoglutethimide, mitotane, trilostane; folic acid replenisher such as frolinic acid; aceglatone; aldophosphamide glycoside; aminolevulinic acid; amsacrine; bestrabucil; bisantrene; edatraxate; defofamine; demecolcine; diaziquone; elformithine; elliptinium acetate; etoglucid; gallium nitrate; hydroxyurea; lentinan; lonidamine; mitoguazone; mitoxantrone; mopidamol; nitracrine; pentostatin; phenamet; pirarubicin; podophyllinic acid; 2-ethylhydrazide; procarbazine; PSK®; razoxane; sizofiran; spirogermanium; tenuazonic acid; triaziquone; 2, 2',2"-trichlorotriethylamine; urethan; vindesine; dacarbazine; mannomustine; mitobronitol; mitolactol; pipobroman; gacytosine; arabinoside ("Ara-C"); cyclophosphamide; thiotepa; taxoids, e.g., paclitaxel (TAXOL®, Bristol-Myers Squibb Oncology, Princeton, N.J.) and doxetaxel (TAXOTERE®, Rhne-Poulenc Rorer, Antony, France); chlorambucil; gemcitabine; 6-thioguanine; mercaptopurine; methotrexate; platinum analogs such as cisplatin and carboplatin; vinblastine; platinum; etoposide (VP-16); ifosfamide; mitomycin C; mitoxantrone; vincristine; vinorelbine; navelbine; novantrone; teniposide; aminopterin; xeloda; ibandronate; CPT-11; topoisomerase inhibitor RFS 2000; difluoromethylomithine (DMFO); retinoic acid derivatives such as Targretin™ (bexarotene), Panretin™ (alitretinoin); ONTAK™ (denileukin diftitox); esperamicins; capecitabine; and pharmaceutically acceptable salts, acids or derivatives of any of the above. Also included in this definition are anti-hormonal agents that act to regulate or inhibit hormone action on cancers such as anti-estrogens including for example tamoxifen, raloxifene, aromatase inhibiting 4(5)-imidazoles, 4-hydroxytamoxifen, trioxifene, keoxifene, LY117018, onapristone, and toremifene (Fareston); and anti-androgens such as flutamide, nilutamide, bicalutamide, leuprolide, and goserelin; and pharmaceutically acceptable salts, acids or derivatives of any of the above.

Illustrative examples of immunomodulators include, but are not limited to: cyclosporine, tacrolimus, tresperimus, pimecrolimus, sirolimus, verolimus, laflunimus, laquinimod and imiquimod, as well as analogs, derivatives, salts, ions and complexes thereof.

In some embodiments, an anti-cancer drug may include a poly-ADP ribose polymerase (PARP) inhibitor. Illustrative examples of PARP inhibitors include, but are not limited to, olaparib (AZD-2281), rucaparib (AG014699 or PF-01367338, niraparib (MK-4827), talazoparib (BMN-673) veliparib (ABT-888), CEP 9722, E7016, BGB-290, 3-aminobenzamide.

All publications, patent applications, and issued patents cited in this specification are herein incorporated by reference as if each individual publication, patent application, or issued patent were specifically and individually indicated to be incorporated by reference. In particular, the entire contents of International PCT Publication No. WO 2016/028316 are specifically incorporated by reference.

Although the foregoing invention has been described in some detail by way of illustration and example for purposes of clarity of understanding, it will be readily apparent to one of ordinary skill in the art in light of the teachings of this invention that certain changes and modifications may be made thereto without departing from the spirit or scope of the appended claims. The following examples are provided by way of illustration only and not by way of limitation. Those of skill in the art will readily recognize a variety of noncritical parameters that could be changed or modified to yield essentially similar results.

EXAMPLES

Example 1: Copy Number Analysis of Samples Containing Blends of Fragmented Genomic DNA Meticulous blends of fragmented genomic DNA were generated that contained DNA derived from ΔATM or ΔBRCA2 immortalized human samples spiked into a fragmented wild-type human gDNA sample. The advantage of this sample type is that the composition can be carefully controlled and sample availability is essentially unlimited.

Figure 7:
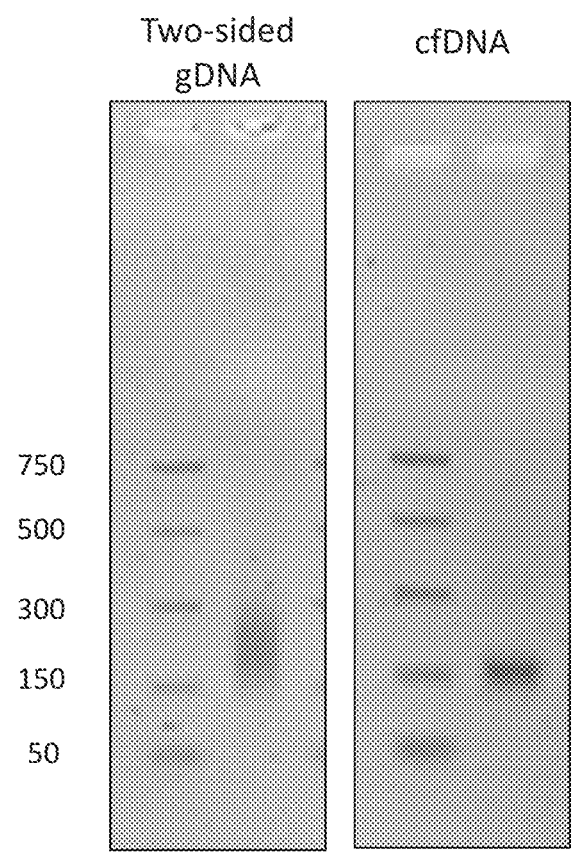
FIG. 7 shows DNA inputs into CNL libraries. Agarose gel images are shown with the sizes of markers (bp) indicated at left.

Wild-type, human female genomic DNA was purified from whole blood samples donated by a healthy volunteer. Genomic DNA isolated from an immortalized cell harboring a heterozygous deletion covering the entire ATM gene (NA09596, ΔATM) and a separate sample bearing a heterozygous deletion of BRCA2 (NA02718, ΔBRCA2) were obtained from the Coriell repository. Importantly, these samples appeared to have an otherwise normal ploidy across the remainder of the genomes. The ΔATM sample was derived from a male donor and was therefore also hemizygous in copy number for the X-linked AR gene. Cell free DNA (cfDNA) was obtained from healthy donor plasma samples of female or male origin. For library construction, genomic DNA was sonicated on a setting of 200 bp with a Covaris instrument, then further size selected using a "two-sided" DNA bead purification. Library input DNA samples are shown in FIG. 7.

Appropriate combinations of fragmented and cfDNA samples were blended to defined percentages, end-repaired, and converted to genomic libraries. Approximately 500 ng of each library was combined in sets of eight samples and hybridized to the copy number loss (CNL) prostate probe pool that contained 2304 DNA probes. Following sample processing, each set of eight samples was sequenced on an Illumina NextSeq NGS instrument to a depth of ~480 million pass-filter reads; this corresponds to 60 million reads/sample. Roughly 95% of reads possessed legitimate sample ID tags and aligned to the human reference genome and of these, ~98% mapped to the intended target loci. The overall sequencing depth, measured as the number of reads per input genome per probe (calculated as on-target reads (60 million) divided by average genome depth (2500) and divided by probe count (2400)) was approximately 10 reads per genome per probe. A graphic representation of the copy number loss analysis is shown in FIG. 1. Copy number perturbations are highlighted by arrows. (Sample 1, 5% male DNA into female DNA; sample 2, 5% ΔATM DNA (male) into female DNA; sample 3, 5% ΔBRCA2 DNA (female) into female DNA; sample 4, pure female DNA).

The CNL caller identifies redundant reads and condenses these into a single consensus reads that are then quantified at each probe location. This information was further condensed into gene-by-gene copy number averages. Finally, a statistical significance was assigned to deviations detected in each CNL measurement; this is shown graphically as the $\log_{10}$P-value of statistical significance.

Figures 9A, 9B:
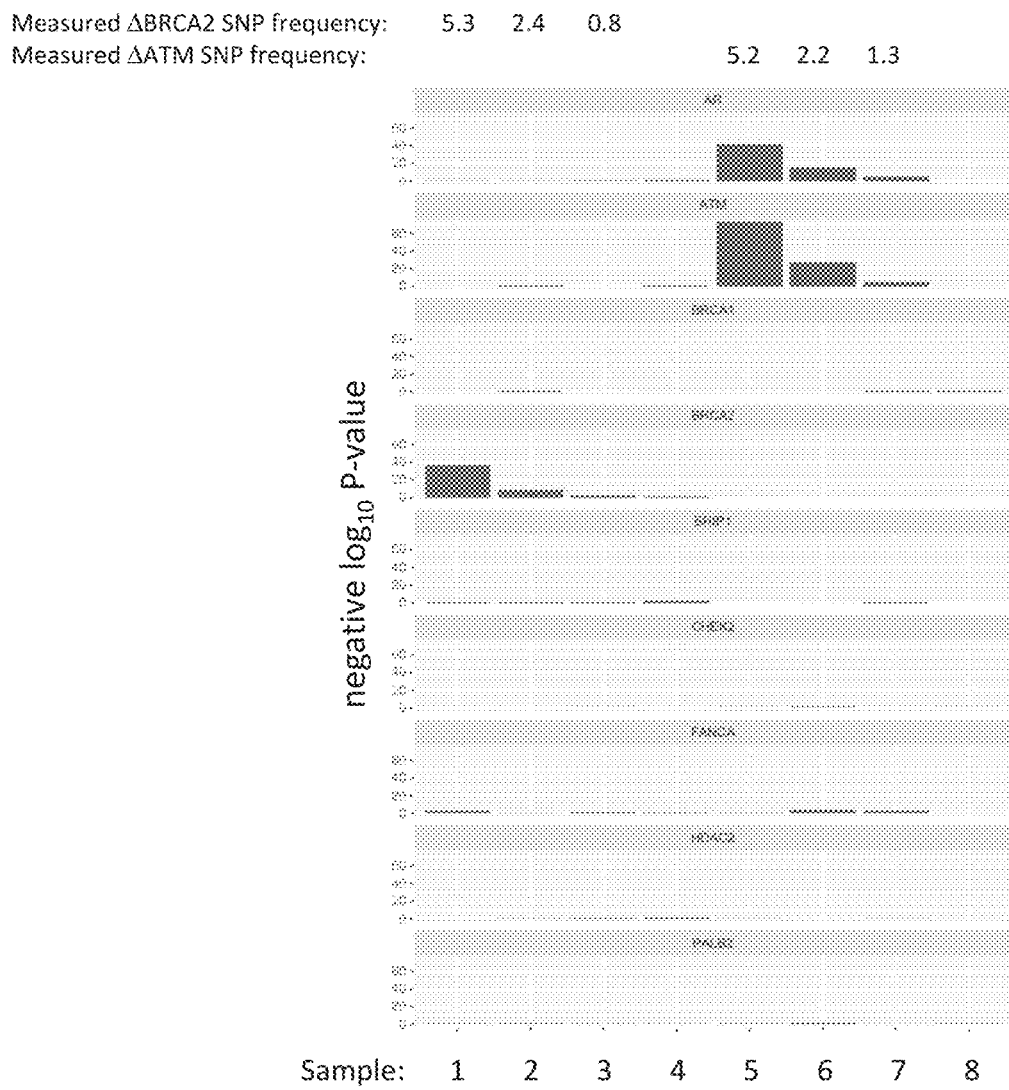
FIG. 9A-FIG. 9B shows $Log_{10}$ P-value plots that quantify significant deviation-from-normal in CNL measurements for fragmented genomic samples. The SNP percentages at the top show the minor allele frequencies of rare, heterozygous SNPs that are present in the ΔATM and ΔBRCA2 samples.
Figures 10A, 10B:
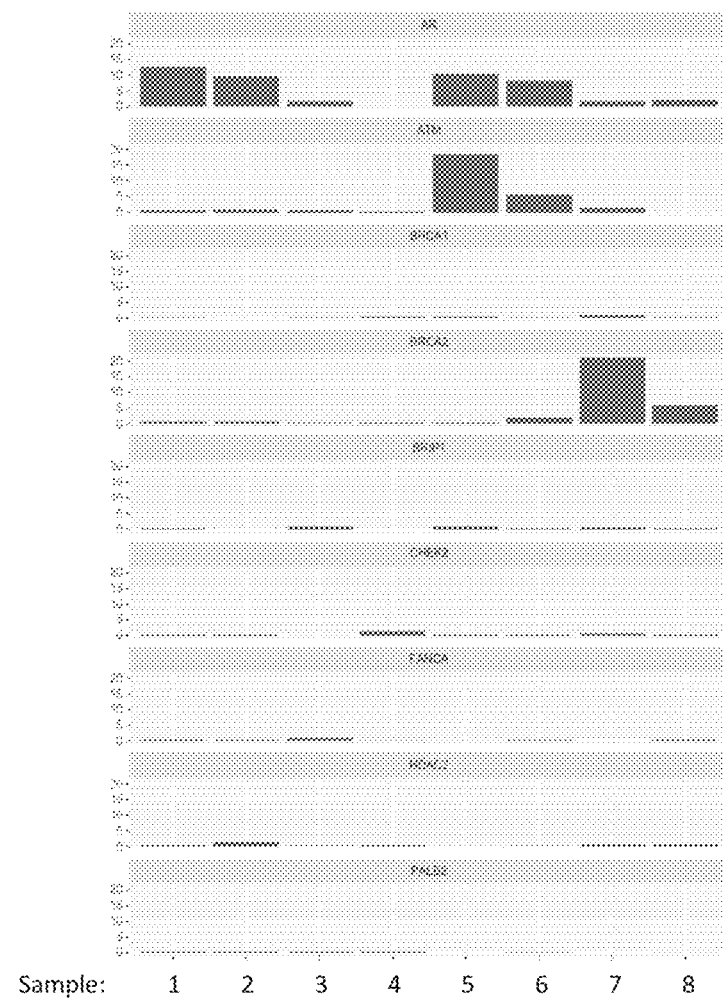
FIG. 10A-FIG. 10B shows $Log_{10}$ P-value plots that quantify significant deviation-from-normal in CNL measurements for cfDNA samples spiked with fragmented genomic DNA. The SNP percentages at the top show the minor allele frequencies of rare, heterozygous SNPs that are present in the ΔATM and ΔBRCA2 samples.

FIG. 8 shows box-and-whisker plots of copy number determinations for the AR (FIG. 8B) and ATM (FIG. 8C) genes in fragmented and blended genomic libraries. Because the ΔATM sample is male, the AR gene (X-linked, hemizygous) and the ATM gene both exhibited CNL behavior. As anticipated, the magnitude of measured copy variation was modest. The statistical analysis shown in FIG. 9B demonstrates that the observed copy fluctuation was statistically significant. Moreover, very little significant fluctuation was observed in the remaining genes that were predicted to exhibit uniform copy characteristics. These values correlated well with frequencies predicted for the various genomic blends. FIG. 10 shows that statistically significant copy fluctuation was also readily observed in samples that were primarily cfDNA with minor spike-ins of either cfDNA from the opposite sex or minor additions of fragmented gDNA. These values correlated well with frequencies predicted for the various genomic blends. The results seen with both fragmented gDNA and with cfDNA were comparable, thereby demonstrating the integrity of the assay and suggesting that the integrity will translate to clinical samples.

These data demonstrate the ability of the assay system to detect subtle changes in gene copy number down to minor allele frequencies of 2%. While the focus of demonstrated examples presented is on copy number loss, the technology is equally well suited to the detection of copy number gains, including increases in gene copy that occur through chromosomal arm duplications and focal amplifications. This assay further retains the ability to detect other types of genomic variants, including SNVs, indels and gene fusions (chromosomal rearrangements). Importantly, these data demonstrate that the method can be applied to genomic DNA derived from plasma, but also to genomic DNA derived from other sources such as tissue and other bodily sources.

Example 2: Copy Number Analysis of cfDNA from Healthy Donors and a Cancer Patient The following example illustrate the manner in which the molecular features added during genomic library construction and post-hybridization processing are used to generate copy number analysis. DNA was extracted from the plasma of sixteen healthy donors and one castration-resistant prostate cancer patient using the Qiagen Circulating Nucleic Acids Extraction kit (Qiagen, Hilden, Germany). The yield of double-strand DNA was quantified using a Qubit fluorometer (Thermo Fisher, Waltham, Mass.) and the corresponding hsDNA quantitation kit. Size analysis was performed using gel electrophoresis on 2% agarose gels with PCR markers as size standards (New England Biolabs, Ipswich, Mass.). Approximately 40-100) ng of cfDNA, depending on the yield of cfDNA from the sample, was used for library construction.

Figure 11A:
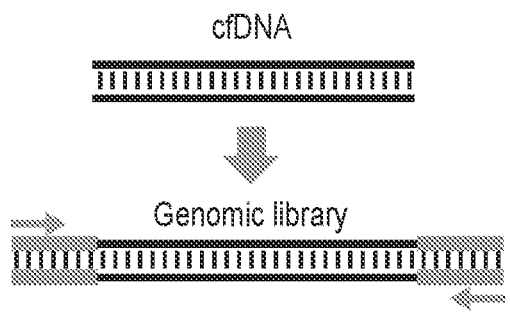
FIG. 11A-FIG. 11D illustrate the targeted hybrid capture platform.
Figure 11B:
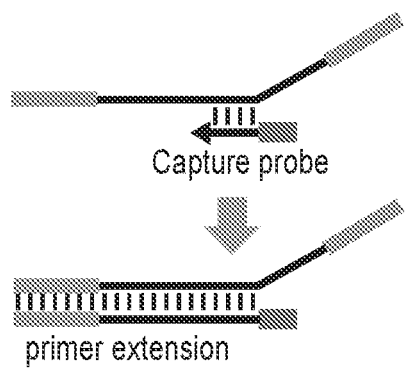
Figure 11C:
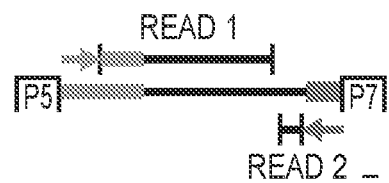

The basic features of library construction are illustrated in FIG. 11A-11C. The cfDNA was first dephosphorylated and then repaired to blunt ends in a two-step process. Short, 10 nt anchor sequences consisting of a phosphorylated ligation strand and an inert partner strand were then ligated to the cfDNA. The eight oligonucleotides used to create the set of four anchor sequences are shown in Table 1.

Figure 11D:
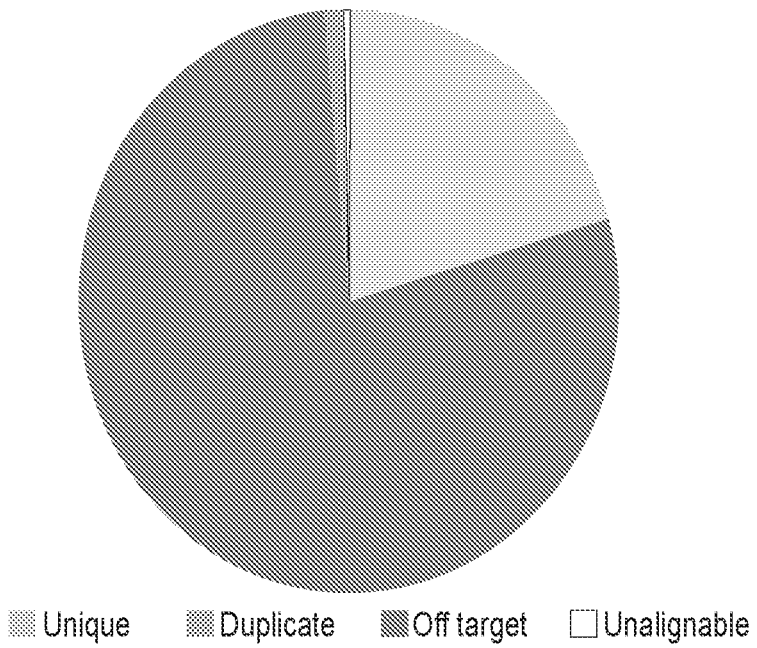

The adaptor structures were completed by the addition of full-length adaptor sequences that annealed to the anchor sequence. Thirty-two sets of adaptor sequences, each composed of 240 members, are shown in FIG. 12-FIG. 22. These adaptors were attached to the cfDNA and extended through the concerted actions of polynucleotide kinase, DNA polymerase and DNA ligase to generate genomic libraries. As a pre-sequencing quality control step, the resulting genomic libraries were quantified by qPCR for depth of coverage. The genomic libraries were then amplified and hybridized to probe sets targeting specific genes (FIG. 11B). Following hybridization, primer extension of the probe was used to copy the captured genomic sequences and the information encoded in the attached adaptor (FIG. 11C). An example of post sequencing analysis using standard next-generation analysis software is shown in FIG. 11D. This analysis was performed on a sequencing run that contained 32 samples (28 cancer patient samples and 4 wild-type controls) and it displays the overall distribution of sequencing reads.

Figures 23A, 23B, 23C:
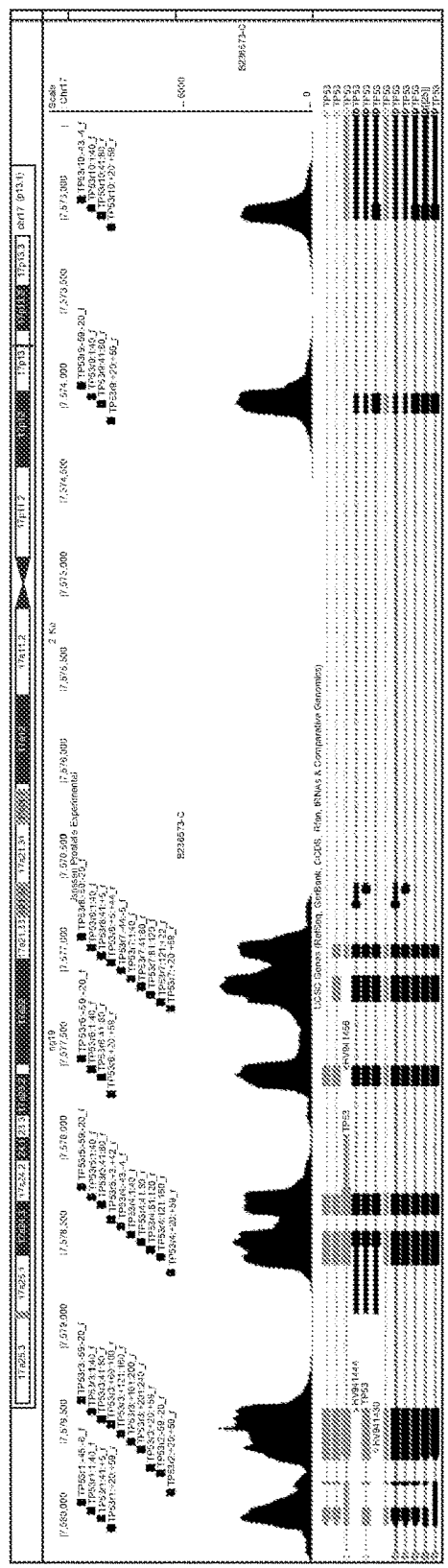
FIG. 23A-FIG. 23C shows targeted sequencing of the TP53 gene.

A central feature of the targeted hybrid capture platform described herein is that it provides multiple types of genomic information. One essential function of capture probes is to provide mutation detection across target regions at a high depth of coverage. This function is governed by the sequence context, density, and placement of the capture probes and is illustrated in FIG. 23 with the TP53 gene (TP53 probe sequences are shown in Table 2 below). Of equal significance, the targeted hybrid capture platform assay generated a readout of equal depth of coverage in regions where no significant mutations were detected. These data are critical to physicians and patients as they add statistical significance in cases where no deleterious mutations were detected.

TABLE 2

TP53 Probes

| Name | Sequence | SEQ ID NO: |
|---|---|---|
| TP53_1 | GGCACAGACCCTCTCACTCATGTGATGTCATCT CTCCTCC | 7689 |
| TP53_2 | ATGGGGGTGGGAGGCTGTCAGTGGGGAACAAGA AGTGGAG | 7690 |

TABLE 1

Ligation anchor oligonucleotides

| Oligo ID | Nucleic Acid Sequence | SEQ ID NO: |
|---|---|---|
| Partner strand oLigation strand oligoo_16-1 | GTATGCC[3-dA-Q]* | 1 |
| Partner strand oLigation strand oligoo_16-2 | AGCGTTA[3-dC-Q]* | 2 |
| Partner strand oLigation strand oligoo_16-3 | TCGACAT[3-dA-Q]* | 3 |
| Partner strand oLigation strand oligoo_16-4 | CATCAGG[3-dA-Q]* | 4 |
| Ligation strand oligo_16-1 | /5Phos/TGG CAT ACG T** | 5 |
| Ligation strand oligo_16-2 | /5Phos/GTA ACG CTA G** | 6 |
| Ligation strand oligo_16-3 | /5Phos/CAT GTC GAT C** | 7 |
| Ligation strand oligo_16-4 | /5Phos/ACC TGA TGC A** | 8 |

*[3-d(A, C, G, or T)-Q] denotes a modified base in which the hydroxyl group resides on the 2' position of the ribose ring
**/5Phos/ denotes the chemical addition of a 5' phosphate group to the 5' base position TABLE 2-continued TP53 Probes

| Name | Sequence | SEQ ID NO: |
|---|---|---|
| TP53_3 | GTCAGTCTGAGTCAGGCCCTTCTGTCTTGAACA TGAGTTT | 7691 |
| TP53_4 | CCTGAAGTCCAAAAAGGGTCAGTCTACCTCCCG CCATAAA | 7692 |

TABLE 2-continued

TP53 Probes

| Name | Sequence | SEQ ID NO: |
|---|---|---|
| TP53_5 | TCATGCTGGATCCCCACTTTTCCTCTTGCAGCAGCCAGAC | 7693 |
| TP53_6 | GTTGGGGTGGGGGTGGTGGGCCTGCCCTTCCAATGGATCC | 7694 |
| TP53_7 | CAGTTTCCATAGGTCTGAAAATGTTTCCTGACTCAGAGGG | 7695 |
| TP53_8 | CTGCCATGGAGGAGCCGCAGTCAGATCCTAGCGTCGAGCC | 7696 |
| TP53_9 | GCAGAGACCTGTGGGAAGCGAAAATTCCATGGGACTGACT | 7697 |
| TP53_10 | CTGGGGGGCTGGGGGGCTGAGGACCTGGTCCTCTGACTGC | 7698 |
| TP53_11 | GCAGGGGGATACGGCCAGGCATTGAAGTCTCATGGAAGCC | 7699 |
| TP53_12 | GTGGCCCCTGCACCAGCAGCTCCTACACCGGCGGCCCCTG | 7700 |
| TP53_13 | GGGGGGAGCAGCCTCTGGCATTCTGGGAGCTTCATCTGGA | 7701 |
| TP53_14 | CCGTGCAAGTCACAGACTTGGCTGTCCCAGAATGCAAGAA | 7702 |
| TP53_15 | CCCCGGACGATATTGAACAATGGTTCACTGAAGACCCAGG | 7703 |
| TP53_16 | CCAGAAAACCTACCAGGGCAGCTACGGTTTCCGTCTGGGC | 7704 |
| TP53_17 | TAGGTTTTCTGGGAAGGGACAGAAGATGACAGGGGCCAGG | 7705 |
| TP53_18 | TGCTTTATCTGTTCACTTGTGCCCTGACTTTCAACTCTGT | 7706 |
| TP53_19 | CCTGGGCAACCAGCCCTGTCGTCTCTCCAGCCCCAGCTGC | 7707 |
| TP53_20 | TTTGCCAACTGGCCAAGACCTGCCCTGTGCAGCTGTGGGT | 7708 |
| TP53_21 | CCATCGCTATCTGAGCAGCGCTCATGGTGGGGCAGCGCC | 7709 |
| TP53_22 | GCCATCTACAAGCAGTCACAGCACATGACGGAGGTTGTGA | 7710 |
| TP53_23 | CATGGCGCGGACGCGGGTGCCGGGCGGGGTGTGGAATCA | 7711 |
| TP53_24 | CCAGGGTCCCCAGGCCTCTGATTCCTCACTGATTGCTCTT | 7712 |
| TP53_25 | GAGGGCCACTGACAACCACCCTTAACCCCTCCTCCCAGAG | 7713 |
| TP53_26 | CCTCAGGCGGCTCATAGGGCACCACCACACTATGTCGAAA | 7714 |
| TP53_27 | AGGAAATTTGCGTGTGGAGTATTTGGATGACAGAAACACT | 7715 |
| TP53_28 | CTTGCCACAGGTCTCCCCAAGGCGCACTGGCCTCATCTTG | 7716 |
| TP53_29 | GAGGCAAGCAGAGGCTGGGGCACAGCAGGCCAGTGTGCAG | 7717 |
| TP53_30 | CCTGGAGTCTTCCAGTGTGATGATGGTGAGGATGGGCCTC | 7718 |
| TP53_31 | ACTACATGTGTAACAGTTCCTGCATGGGCGGCATGAACCG | 7719 |
| TP53_32 | GGACAGGTAGGACCTGATTTCCTTACTGCCTCTTGCTTCT | 7720 |
| TP53_33 | CTGCACCCTTGGTCTCCTCCACCGCTTCTTGTCCTGCTTG | 7721 |
| TP53_34 | TCTCTTTTCCTATCCTGAGTAGTGGTAATCTACTGGGACG | 7722 |
| TP53_35 | CCTCGCTTAGTGCTCCCTGGGGGCAGCTCGTGGTGAGGCT | 7723 |
| TP53_36 | GACCGGCGCACAGAGGAAGAGAATCTCCGCAAGAAAGGGG | 7724 |
| TP53_37 | TCTCCCAGGACAGGCACAAACACGCACCTCAAAGCTGTTC | 7725 |
| TP53_38 | TGCCTCAGATTCACTTTTATCACCTTTCCTTGCCTCTTTC | 7726 |
| TP53_39 | GGCATTTTGAGTGTTAGACTGGAAACTTTCCACTTGATAA | 7727 |
| TP53_40 | CCTGAAGGGTGAAATATTCTCCATCCAGTGGTTTCTTCTT | 7728 |
| TP53_41 | CCTAGCACTGCCCAACAACACCAGCTCCTCTCCCCAGCCA | 7729 |
| TP53_42 | CATCTTTTAACTCAGGTACTGTGTATATACTTACTTCTCC | 7730 |
| TP53_43 | ATGGCTTTCCAACCTAGGAAGGCAGGGGAGTAGGGCCAGG | 7731 |
| TP53_44 | CCTGGAGTGAGCCCTGCTCCCCCCTGGCTCCTTCCCAGCC | 7732 |
| TP53_45 | TCCGAGAGCTGAATGAGGCCTTGGAACTCAAGGATGCCCA | 7733 |

The linkage of the capture probe with captured genomic sequence (FIG. 11C) also facilitated measurement of genomic depth at each probe location. The number of unique reads associated with every capture probe used in the experiment was measured (FIG. 24). The data shown in FIG. 24 was derived from a sequencing run in which 16 healthy donor cfDNA samples were analyzed. The depth of unique reads encountered in each sample at one probe location in the TP53 gene were calculated (Raw unique read counts shown in FIG. 24A). Each sample comprised a unique library depth, as reflected in the broad sample-to-sample distribution of unique reads. The global average of unique read depth across all 2596 capture probes in the experiment was also calculated (FIG. 24B). Significantly, normalization of the observed read depth at the single probe site displayed in FIG. 24C by the global unique read depth measured for all probes revealed a uniform density of normalized unique reads. These data indicate that the capture performance of a particular probe chosen for analysis was uniform from sample-to-sample and proportional to the genomic depth of each individual library.

Figure 25:
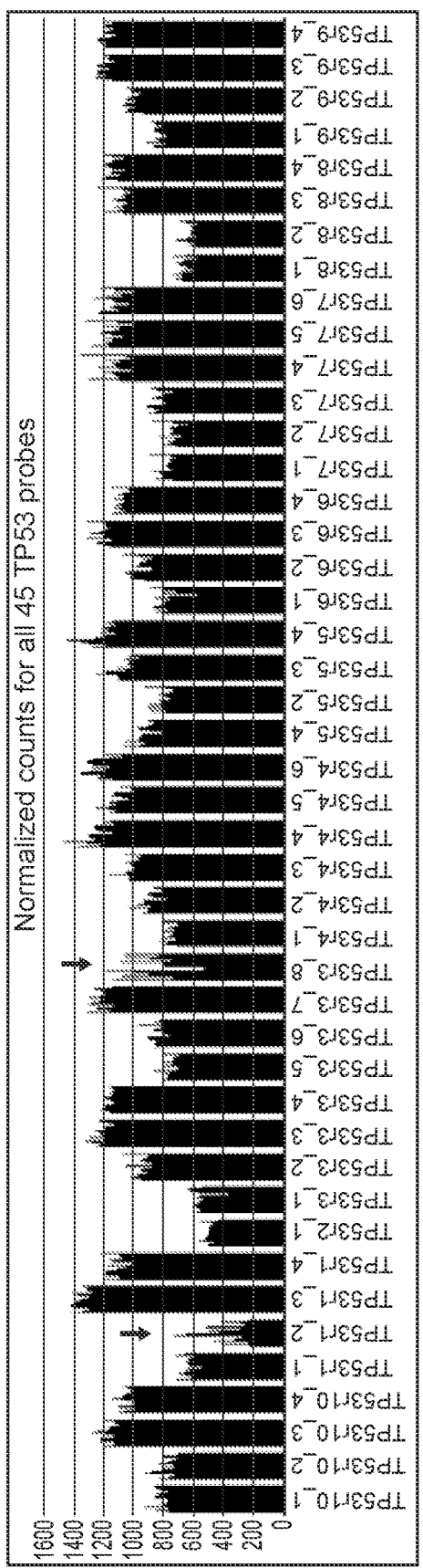
FIG. 25 shows general consistency of the normalized unique read counts for all 16 samples within any given TP53 probe despite significant average depth variation between probes. The normalized unique read counts for all 16 samples are shown as "pillars" of tightly spaced bar graphs; the results for all 45 probes that target TP53 are shown. Two probes that exhibit "noisy" counting behavior are highlighted with arrows. Counts from such probes often appear as outliers in subsequent copy number analysis.

This same normalization function was applied to the 45 TP53-specific probes shown in FIG. 23 (normalization data shown in FIG. 25). Whereas FIG. 23 shows the aggregate contribution of all probes to the sequencing depth of TP53 coding regions, FIG. 25 shows the normalized depth retrieved by each individual probe. The normalized depth retrieved by each individual probe was generally consistent from sample-to-sample for any given probe but somewhat variable when one probe was compared to another. Several factors governed the differences in the post-normalization capture depths observed between probes, the most significant being the placement of probes relative to one another and the proximity of probes to genomic repeat regions. Not all probes exhibited uniform capture behavior; two probes whose capture performance were not consistent are highlighted by arrows in FIG. 25. However, these data indicate that such probes are rare and easily identified. As such, and they can be excluded from downstream copy number analysis.

Figure 26:
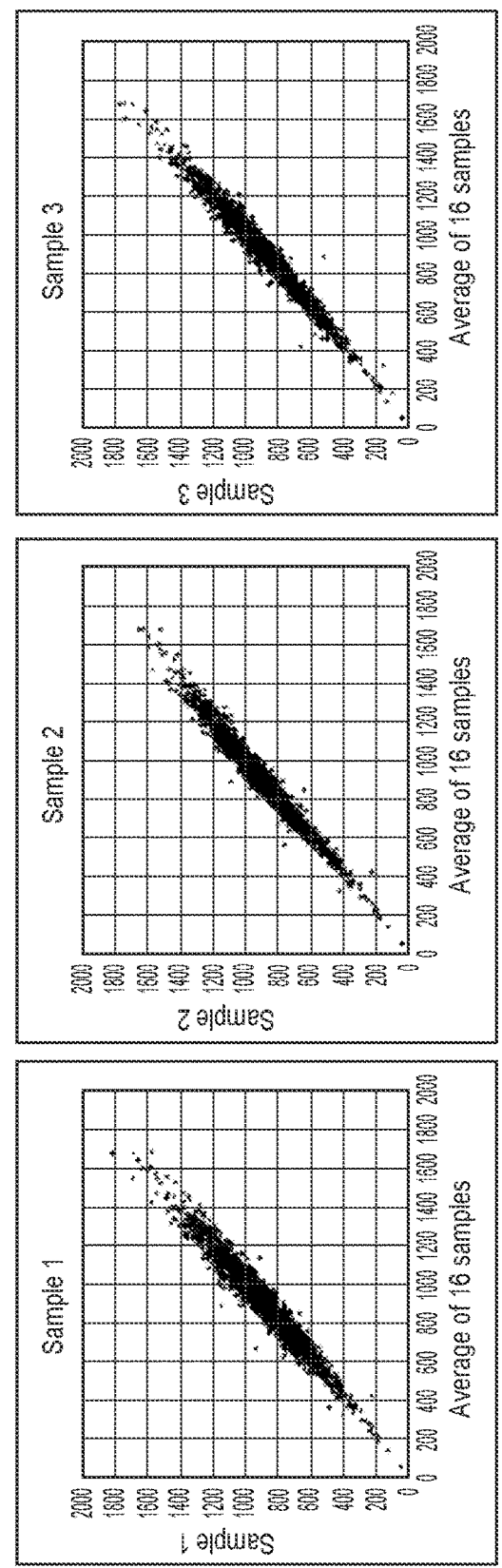
FIG. 26 illustrates sample-to-sample consistency of normalized probe-by-probe unique read counts across a broad panel of 2596 probes. The scatter plots from three representative samples are shown. Each dot represents a different probe. The x-axis is the normalized average unique read depth per probe across 16 samples. The y-axis is the normalized unique read depth per probe for three different individual samples. The consistent probe-by-probe unique read counts support quantitative analysis of chromosomal copy variation.

The uniform capture performance exhibited by the 45 TP53 targeting probes in FIG. 25 is a general feature of the targeted hybrid capture platform described herein. In FIG. 26, the average capture depth for each probe in a panel of 2596 capture probes was calculated for all 16 normal cfDNA libraries that were profiled in this experiment. The average was then compared individually with three representative samples using scatter plot analysis. Each dot represents a different probe and its position on the graph is a comparison of the average on the x-axis and the individual sample on the y-axis. The tight diagonal distribution of the majority of probes reflected the highly-correlated unique read capture performance of most probes ($R^2$ correlation ≥0.95 for all three graphs). Importantly, the consistency of probe-by-probe sequencing depth supports the use of the targeted hybrid capture platform in copy number measurement.

Figure 27B:
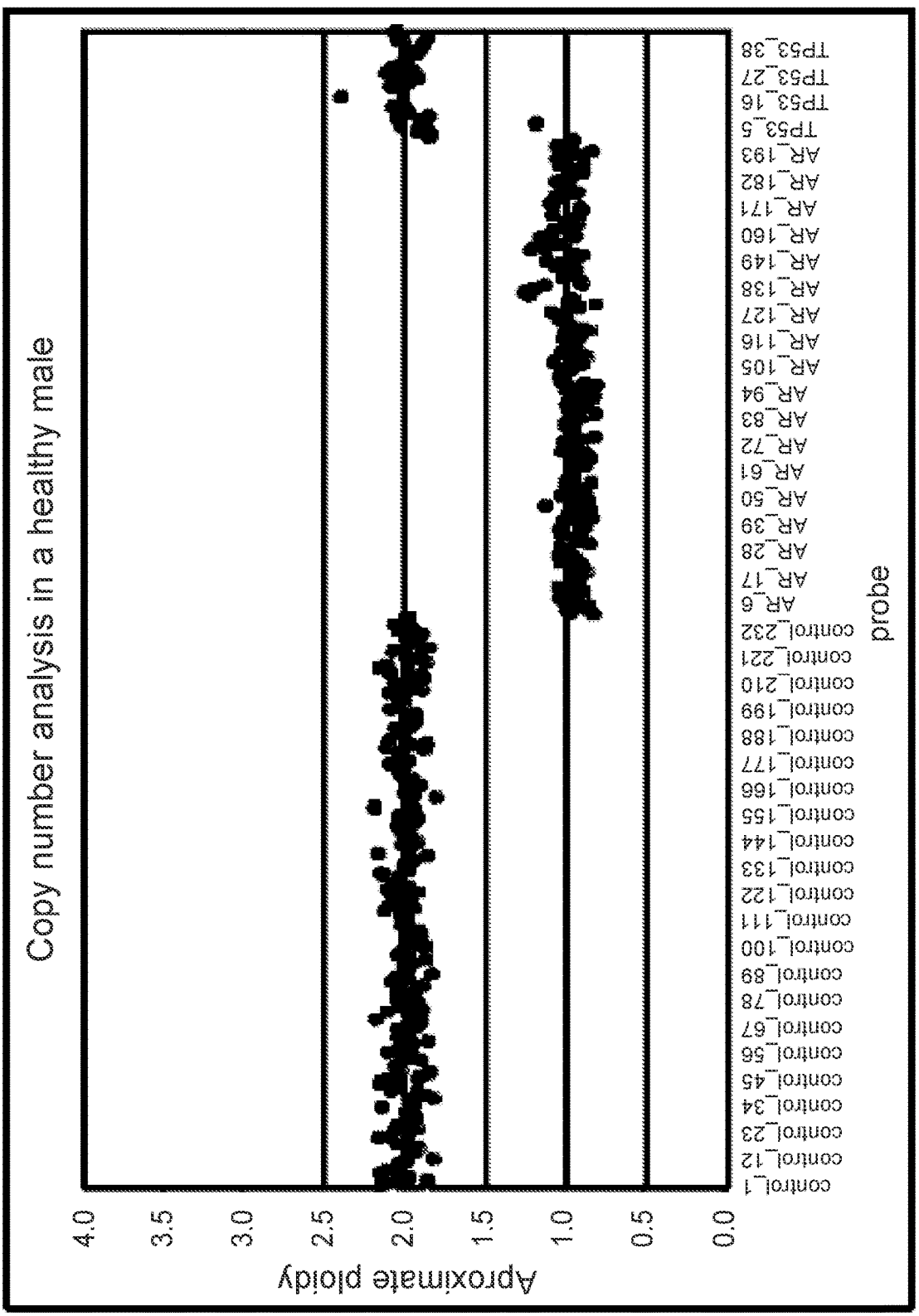

With respect to copy number, the most straightforward treatment of probe data is to further normalize the adjusted genomic depth values that occur in autosomal chromosomes to a diploid-averaged value of "2". The same is true for probe values that occur in females for X-linked loci. For X-linked and Y-linked regions in normal males, averaged copy values are appropriately set to "1". This numerical transformation was applied to a set of chromosomal control probes (239 probes that target select loci on all 22 autosomal chromosomes, Table 3), a set of 199 probes that target the X-linked AR gene, and the 45 TP53-specific probes considered in detail above (FIGS. 27A and 27B). Each dot represents the value for an individual probe. With the exception of infrequent "noisy" probes, the vast majority of individual probe counts in regions anticipated to be diploid possessed values that were approximately "2". Probes for the AR gene in a healthy male fluctuated with an average value close to the anticipated "1."

TABLE 3

Chromosomal Control Probes

| Name | Sequence | SEQ ID NO: |
|---|---|---|
| Chr_1_1 | GTGTCTCGGCAACCACTCTTCACCAATATCACAGTGGACA | 7734 |
| Chr_1_2 | ATCCAAGGGGAGGAGATCAGTGCCCCTATTTGTATCGCAC | 7735 |
| Chr_1_3 | ACTTACTGAAGCAAGAACCTCATCAAGCTGCCTCCCACCA | 7736 |
| Chr_1_4 | AGTTTGTGATCCTCCTGTGGGCAACCTCAGCAGTCTGGTT | 7737 |
| Chr_1_5 | GGAGAGCGGAGCTGCTCAGAGCTTGGCCAGGTTCTAAGTG | 7738 |
| Chr_1_6 | GACTGTGGCAATGAGGCAGCTAAGTGGTTCACCAACTTCT | 7739 |
| Chr_1_7 | GGTGTATTTTGACAACGGTGGACCCAGACACTGGAGTCAT | 7740 |
| Chr_1_8 | GTTGGTCTATTCTTGCGGTTGTAAAAGTGGCCCAGAGTGA | 7741 |
| Chr_1_9 | GTGAGCCTTCTCTCACCATTCTGTCCAAAATAGCAGCCCT | 7742 |
| Chr_1_10 | CAGCCTAGATATGATTCCTCACTACCCTGTTCCATGGTTC | 7743 |
| Chr_1_11 | AAAGAATGTGTTGGCTCATGATCAGACTTGAGCACTTGGG | 7744 |
| Chr_1_12 | CCTAGGCTGTTGCTGCTGGACCTGTTTGTGCTTCATCACA | 7745 |
| Chr_2_1 | CAGTTGACCCTTCAGCCACAGGGGTTTGAACTTTGAAGGA | 7746 |
| Chr_2_2 | AGGACCTGAGTATGCACGTTTTGGTATACTGGGTAGGGGT | 7747 |
| Chr_2_3 | TATCAGCTGGGATGGTCCGGTCAGCAGCATTACCCTGTTT | 7748 |
| Chr_2_4 | TGCCTGCTCAGCCCAGATTTCAGTCATGCTGGCCATAAAC | 7749 |
| Chr_2_5 | CTGGGGGGTGAGGTTTGAGGTTTGAGTGTGGGATGTGAGG | 7750 |
| Chr_2_6 | CCAGCTTTTTCAGAAGCTGGGAAAGTAATAACCCGTGTTG | 7751 |
| Chr_2_7 | CCCAGCGCCCGTGGCTTTGGCTCCTCAGTCCCATTTAAAT | 7752 |
| Chr_2_8 | TATACCACCAAGTCTACCTACTGCCTGCACATGCTATGGC | 7753 |
| Chr_2_9 | GGTCAATCCGGCACTACTGGTTGTCCAAAGGGAGGTTACT | 7754 |

TABLE 3-continued

Chromosomal Control Probes

| Name | Sequence | SEQ ID NO: |
|---|---|---|
| Chr_2_10 | AATCAAACATCAGGACCGCCCACAGCACAGGTCAATGAAC | 7755 |
| Chr_2_11 | GTGTCTCCTGGAGGTGCATGGGTGGTTTTGAACTTCATTG | 7756 |
| Chr_2_12 | GACCCATGTAAGGGGTTGGGTTATGTTCTCCTTTTGCCCA | 7757 |
| Chr_2_13 | TCACTGACATGCGAAGCTGGGAACGAGAAAATGCACATCC | 7758 |
| Chr_2_14 | TCCTACAGTGCTTAGGGATGAATCTGGCAAAGAAGGATGC | 7759 |
| Chr_2_15 | GAAAGCAGTCCTTACCACAAGAAGACCCCGATGTGGTGGT | 7760 |
| Chr_2_16 | ATTGCTCACTGGCTGGCTTGCATTTGGTATGCGATTGGGA | 7761 |
| Chr_2_17 | GTCCCTGGGACCATCTGTGCATTGTTCTTGTAACTGGAAA | 7762 |
| Chr_2_18 | GACCGAATGGCGAACGCAGTGAATAGATCAGGAGGGAAAA | 7763 |
| Chr_3_1 | GAAGGAATGGAGTGGAACAGATAGGGGTGAGGGAATAACG | 7764 |
| Chr_3_2 | CCACTGCCATCCTCAGAGGGAGATTCACAAGTCTCACAAT | 7765 |
| Chr_3_3 | ATCCAGGCTTCATGTTCAAATGCAATGGCCCTTGCCCCAT | 7766 |
| Chr_3_4 | AAATTTCCCCTGGCTCCCTACTGCTTTGCAGGCCAAGTAA | 7767 |
| Chr_3_5 | ACCTTAAAGACGGGCCCACATCTCTTTGGATGGGATTAGG | 7768 |
| Chr_3_6 | GGGCTTCGGTTTTGGCGAAGGTGCTCACAATCTTGATATC | 7769 |
| Chr_3_7 | TGAGCTGTCCTTCATGCCTGCATTTCCCATGTCTGTCTTC | 7770 |
| Chr_3_8 | ATCTTTATCCAGGGCTACCAGTGGTGGGTCCAAAATGACT | 7771 |
| Chr_3_9 | TACAGGTGAAGGATGTCAACGAGTTTGCTCCCACCTTCAA | 7772 |
| Chr_3_10 | GCTGTTGTGACGGAGGGCAAGATCTATGACAGCATTCTGC | 7773 |
| Chr_3_11 | AATGAAGGGGATTCAAGCCTTGCCACCGACTTACAGGAAG | 7774 |
| Chr_3_12 | TGTGAGCGTACTTTCTCCCCCAGGTTGAAGAGGAATGAGT | 7775 |
| Chr_4_1 | ATTCCAAGTCCAGGTCCCAAATCTATCAGTACCGGCTGGC | 7776 |
| Chr_4_2 | GACACAGAGTGCATGAAGACCGTTCAAATATGTCAGGGAC | 7777 |
| Chr_4_3 | CATGAGTCCTTCTATGACTCCCTCTCAGACATGCAGGAAG | 7778 |
| Chr_4_4 | TTTTTAGGAGACAGGTACCCACTGTCTGGTGACGAGGACT | 7779 |
| Chr_4_5 | CCTTCTGTTGAGTCGCTAGGAGATGCCTCAGTTCAACAAT | 7780 |
| Chr_4_6 | GACAGAAACTTCATACCCAAGAGCTGCTTTCTCAGCTGGA | 7781 |
| Chr_4_7 | CAGGCAACTTTGGCAAGACCAAGTCAGCCTTCTCATCTCT | 7782 |
| Chr_4_8 | CCCTTGCTACCATCACTGTTGTCATCTGTGCTTGCATTCC | 7783 |
| Chr_5_1 | AGGTCTCACTCCAACTGCCCCTGTATTAGAGCTAGGCTGC | 7784 |
| Chr_5_2 | GAAACCATGCGGGATTCATCTTTGTCAGAGTGGAGCGGCA | 7785 |
| Chr_5_3 | TATGAAATTAGGCGGTGGTTGGACGTGACTGTGTGTTGAC | 7786 |
| Chr_5_4 | TGAAACTTGCATGACATACTGCGGCTGCCCATTCACTAGG | 7787 |
| Chr_5_5 | TGCTTCTTGTTTATAACTCCCCTGGCCACCATCTCGGGCT | 7788 |
| Chr_5_6 | ATTCCCTCTCATTTGTGGTTGGTGGCTGGATATCTGTTCC | 7789 |
| Chr_5_7 | AGCATCAGCATTTCCCTGTGGACTTACCTCTCTCAGTAGT | 7790 |
| Chr_5_8 | AAAATTTAAAGGTCGGCGGTAAGGCTGAAAGCCAACAGGC | 7791 |
| Chr_5_9 | GAGTGTGTCGGTCAGAAGGAACACCTGAGAAACCGCTTTA | 7792 |

TABLE 3-continued

Chromosomal Control Probes

| Name | Sequence | SEQ ID NO: |
|---|---|---|
| Chr_5_10 | CATAGCAAATACCTGTCGCTGAGCCAGGAGTAAAGTCTGG | 7793 |
| Chr_5_11 | AAGAGGCTCTGAGCTCTTGATAGAGGTTACATGGGGAGCA | 7794 |
| Chr_5_12 | GGAGACAACTTAGGAGGTTATCTAGACCATTCCCGCCTTC | 7795 |
| Chr_5_13 | GTGTTTCCTCCCAGCATGCACTTTGTGGCTGCCTTTCTTT | 7796 |
| Chr_5_14 | TGGCTTGTGTAGCGTGTTTCATTTTGGAACCTTGGAGCCG | 7797 |
| Chr_5_15 | GACACCTCTGGTGCAGTTTTGAGGCTGGCCGGGAAGGGAT | 7798 |
| Chr_5_16 | GTTTCAGATCTTGCAATGGGAGGGATCGACTCGGCCCTTT | 7799 |
| Chr_5_17 | TGCCTAAATCAGAAATGGGCTACTTCCCTTGGCCACATCC | 7800 |
| Chr_5_18 | CAATCTACCACCTCAAGGTTCACGCGTGGATTCTACACCT | 7801 |
| Chr_6_1 | GAGTTTTTCTTTCAGGTAGTCTGAGATGGCCCGCACCAAG | 7802 |
| Chr_6_2 | TACTATAAAGAAGGCACCTCTAGGCTTGGCAAGCACACGT | 7803 |
| Chr_6_3 | GGCAGATTCGATGGGACTTTAGACACTTGCTTTGCTCCCT | 7804 |
| Chr_6_4 | CAAATGTCCCCATGCAAACATGTCCCGCACTGTGTGGTAA | 7805 |
| Chr_6_5 | ACATGTGTAATCTTCTTCTCCTAGGGCGGCAGAACTCATG | 7806 |
| Chr_6_6 | CCCGAGGAAAGCTCCTCTTTGCTGACTGTAATGTACTGCA | 7807 |
| Chr_6_7 | GAGGACAGCATTCGCATATCAGGTCGAAATTTCTCCGCGA | 7808 |
| Chr_6_8 | GTCCAGCTTTCATCCTTGATCCTGCTACTCTAGGCTCTCC | 7809 |
| Chr_6_9 | ACTGATGGTGTTCACTTGCACCATCAGGTCTGATGGAGGA | 7810 |
| Chr_6_10 | AATTGGTTCACAAAGCGTCGGGTGATCCAGTAACAGTCGA | 7811 |
| Chr_6_11 | CAGAACTCTGCTCTAACGCCAAGCCTTCAATATGTCTTCG | 7812 |
| Chr_7_1 | CAATTCTTACCATCCACAAAATGGATCCAGACAACTGTTC | 7813 |
| Chr_7_2 | ACTACACCTCAGATATATTTCTTCATGAAGACCTCACAGT | 7814 |
| Chr_7_3 | TGCTATAGACGCACAAACGACCGCGAGCCACAAATCAAGC | 7815 |
| Chr_7_4 | CCATGACTTATGTGCAGCTTGCGCATCCAGGGGTAGATCT | 7816 |
| Chr_7_5 | AGGAGTTGGTGGCTAAACCGCTGACTTTTCTATTGCAGAC | 7817 |
| Chr_7_6 | GAAATATAACAGGACCAGAAGTGGCTCGCAGGAGACTCAT | 7818 |
| Chr_7_7 | TAGCCAGACAGAAGGCGGACACTGATGATACCTCAAGACT | 7819 |
| Chr_7_8 | GTTTGCCACCAGCGAAGAGAGCCATCCTGGTAGAATTGGA | 7820 |
| Chr_7_9 | GGAGATATGCACTTGCCCTTTGGTAATCCTGCTCCTTCTG | 7821 |
| Chr_7_10 | AAAACTAACCAGTAAGTACAGGGAGGGACCGAGAGGCATC | 7822 |
| Chr_7_11 | AAGAACACCAGTCCATAAAGACGCATGTCCGGTGATGCCT | 7823 |
| Chr_7_12 | AATCTGTTTAGACTGAGCAACTGTGCCAGCAGAGGGACCT | 7824 |
| Chr_8_1 | AAGATGGCGAAGGTCTCAGAGCTTTACGATGTCACTTGGG | 7825 |
| Chr_8_2 | CCATGCCTGCCAGCTGATAAGATTTGGTTACCTTTCCATG | 7826 |
| Chr_8_3 | GCTGCAAGAAAGCGTAAGATTGCCATTCGAAAAGCCCAGG | 7827 |
| Chr_8_4 | ATGCAGGAGTACAATGTGGGCATGTCCACCCTCTACGACA | 7828 |
| Chr_8_5 | AGAACGGCTTTGCTGTCTTCCGGCAAACCTATGGTTCTGA | 7829 |
| Chr_8_6 | TGGCTTTGGCGCTTTAAGGCCAGACACGGCATTAAAAAGC | 7830 |

TABLE 3-continued

Chromosomal Control Probes

| Name | Sequence | SEQ ID NO: |
|---|---|---|
| Chr_8_7 | GCAGGCAGAGAAAGATGGCTTTAGAAACCTCTTCCCCACC | 7831 |
| Chr_8_8 | TCAGCTGTGGCCATTGGTGGATCTCATCCTTAGTACTAGT | 7832 |
| Chr_8_9 | CCATGGTTCTGTGAGACTGGTAGAAAGCACAGACCCCTTA | 7833 |
| Chr_9_1 | AATGTGCTTATCACTCGTGATGGGGTCCTGAAGCTGGCAG | 7834 |
| Chr_9_2 | AGGGTCTCATTTTAAGACAGCTTGATTTGAGGGTGAGGGG | 7835 |
| Chr_9_3 | CAGTTGCAAACCATACTTCCTTCAGCCCAGTCCTGTCTAT | 7836 |
| Chr_9_4 | GTCTAAGGGCATCTTACCTCCAAGAACTGCTTGAGGCGTA | 7837 |
| Chr_9_5 | TACCTAGGGAATGACCACTAAGCACCATCTCCGTCACTCT | 7838 |
| Chr_9_6 | GGAAGAGAGGAGGGTCATCCAGTCAGTTTTGCAGGAATCT | 7839 |
| Chr_9_7 | TGCTGCAGTGTCGGAAGAAACCTACCTGCGTTTCTTAGAA | 7840 |
| Chr_9_8 | CATCATACCTATGGCATAGCCATCAGGGCACTGCAGTTTG | 7841 |
| Chr_9_9 | TATATCTCACGTGACCGAGGATGGGTCGTGGGCATTCACA | 7842 |
| Chr_9_10 | GAAATGGCCATCTATAGGTGGGAACCACTCCAGTGTCACA | 7843 |
| Chr_10_1 | GGAAACCTTTCAGTCTCTACTAGAAGCGCGGAGAGAACTC | 7844 |
| Chr_10_2 | TCTGGCCGGCATTCATTTAAGGCCTAAGGATGAAGGCGGT | 7845 |
| Chr_10_3 | AGATACCCTATCGTTCCTTATCTCAGCGAAACAACTCCCC | 7846 |
| Chr_10_4 | CGCAACTCCTCCAGATCGCAGTGGTGCTTCTTCACTTTCA | 7847 |
| Chr_10_5 | TGATTCCATGGTTGCCCGTATACTCCATAAGGCGGTACTT | 7848 |
| Chr_10_6 | ATACCATATCCGGCTTGGTTAGGAGGAGGTATTACAGGGG | 7849 |
| Chr_10_7 | GTACCTGTTAACCCAGACGCAATTCTCCACAGGTACACAG | 7850 |
| Chr_11_1 | ATGTGACACTTGCATCCAGGGAGGTCACCATCTGTGTATG | 7851 |
| Chr_11_2 | CTAGGTCCTGAAGAGGTGGCAAGGAACCAGGACAGAACAT | 7852 |
| Chr_11_3 | TCTGTCATTGGTGACGCCATCTAGACTCTTGGCTTTGGGA | 7853 |
| Chr_11_4 | AAGGTATAGAGCTGGGCGGCTTTCCTCGTTATAGGTGGAG | 7854 |
| Chr_11_5 | CTCCTACGTAGCCGGGTAGAAACTTATGGCAGAAGTCAGG | 7855 |
| Chr_11_6 | TGGATTCCCAGGGTTAATTGTGACCCATTGCAGGAAGGTG | 7856 |
| Chr_11_7 | AATGCTGTCCTACTATGGTCTGTACCTGTCCCAGAGGTGG | 7857 |
| Chr_11_8 | GTGCACCTGGAGAGCATACAGGGCACTGACTTGTAGATCA | 7858 |
| Chr_11_9 | TTCCATCTCGCATAACCTGCCCCTAAACTCTTCTCGGTTC | 7859 |
| Chr_11_10 | ATGAAGGCCTGCTTTGAGTTATCAGATAGGAAGGGGCCAG | 7860 |
| Chr_11_11 | AGGTCATGTCCCGCTTTTGGCTGAACCTAGTTTTGCCCAA | 7861 |
| Chr_12_1 | CTGCATTCTCCATGAGTAGAGTACGAGCCTCATGTTGGTA | 7862 |
| Chr_12_2 | AAGGCTGTCTTCACCAACTGGGTAGGTGTGGATCAAGACC | 7863 |
| Chr_12_3 | CTGACTTTGGTGTTGGGGAGTCGGTGGTCCTTCTTCCATT | 7864 |
| Chr_12_4 | ACTGCAGAGGACCAGACTGGGAAAACAACGATATGGCAGG | 7865 |
| Chr_12_5 | CCTGGCTTAGAAGTCTGGCCGGTCCTTCTTCAGCTTCTTA | 7866 |
| Chr_12_6 | AATCTCAGAAAGAGTTCCTGGGACCATGGCAAATGGTGGC | 7867 |
| Chr_12_7 | ACATTATATCCGGTCCAGGAATATCTGGCTCAGGCTGGGT | 7868 |

TABLE 3-continued

Chromosomal Control Probes

| Name | Sequence | SEQ ID NO: |
|---|---|---|
| Chr_12_8 | AAGCACAGGAAATGTGCCTCACACGACTTCACATGCCCTT | 7869 |
| Chr_12_9 | GGGGGCTTTGCGGGAAGAGGGGACTAAACAACCCTTCTGT | 7870 |
| Chr_12_10 | AAAAGAAATGCGATCAGCGCAACCCATCCGGTGTGGCGCT | 7871 |
| Chr_12_11 | GGCAGTGGTACCATGACATACTTAGCAGAGATGGACTACA | 7872 |
| Chr_13_1 | ATTTCCCATGCGAGAGGTAGCTTGCCCAGGCTGTTGGATA | 7873 |
| Chr_13_2 | TTCCATGCCGAGTCCTGATGGAAACTAGCACTGAAAGACC | 7874 |
| Chr_13_3 | TCACGGGAGCTTCCTTCACTGAGTTCTGCGAATCTGAAGC | 7875 |
| Chr_13_4 | TTTCCAGAGATGAAGCACTACCCAGTCTTACCCAAGTTCG | 7876 |
| Chr_13_5 | CCACCGAGAACAGTGATGAAGGACTTAAAGTGAGAGATGG | 7877 |
| Chr_13_6 | GTTCACTCGTCGGTTTTTCACCAACCACAGACTAGCCTCA | 7878 |
| Chr_13_7 | ACGCAGCTGTGTTGAGTGCACAGGAAGCTCTTAGGGTTAA | 7879 |
| Chr_13_8 | TCTCAGTGAACAGAGGGCTCACTGAGAGGACTTTGAATAC | 7880 |
| Chr_13_9 | ATGGCACAGGCCACATACTGGAATGAATGACGGGCTTCAT | 7881 |
| Chr_13_10 | TGCTGCTTGATGGTGGCATCACTGTCCCCTCATTCCATGA | 7882 |
| Chr_14_1 | GGACACATGTGGACAGTGTGAAACCTCAGAACACTAACCC | 7883 |
| Chr_14_2 | AAGTTCTTATCCTTAGGGACCCAGCGGAGACCTTGGTTCT | 7884 |
| Chr_14_3 | CGACGATGCCTGGGAATAGGATCCATGGGATTGATGAGAA | 7885 |
| Chr_14_4 | GGGAGCCATGAAGATTTCTCCCAGCTCCTGAGGAACTTTG | 7886 |
| Chr_14_5 | TCTGGTCCTCAAGTCCTCAGCTGTAGAAGTTCTCATTGCG | 7887 |
| Chr_14_6 | TGCCAACCCTGGAAACTGGCTTGTGTGTCCACAACAGAAA | 7888 |
| Chr_15_1 | TAGGTGACAGCACTGTCCTTTCCCTGCCATTTGCAGGGAA | 7889 |
| Chr_15_2 | TTCTTCTAGATGGCAGACATTGTTGAGGCCTCCCGTACCT | 7890 |
| Chr_15_3 | AGAGAGCTGCGAGACAAGACTTGGAGTGCGACAAGATTTC | 7891 |
| Chr_15_4 | TTCAATCAGGTACTCCGAGTTCCCTTGGAGGCCAAAAGGA | 7892 |
| Chr_15_5 | AGGAATATGGGGTCCATCTGAGACTCGCAAGTGATGATAC | 7893 |
| Chr_15_6 | GATCTCCAGGACCAGCTCTCAGAAATGCACGATGAACTGG | 7894 |
| Chr_15_7 | ACAGTGTGATGGAGCAGCAGTCCAAGTTCATCCTCCAAGA | 7895 |
| Chr_15_8 | AAGATGACAGGATCCAGGAAACAAGACGCATGGGCCAGAA | 7896 |
| Chr_15_9 | AAAGAGTGGGTCTGTTAATAATCAGGCCGAGACCACCAGC | 7897 |
| Chr_15_10 | CACCCTTGTTCGTGGCCCTTGCTTGGTAAACTGGTATCCA | 7898 |
| Chr_15_11 | CCCAAGTATGGGTGAGGATGCTAGAAATGCCCACATAATG | 7899 |
| Chr_15_12 | AAGACTGTCATTGGTAGGTCATGATCCTTGGCAGCATGAC | 7900 |
| Chr_16_1 | GTGGGGACGGTCATTATCAGCTTTCTGGACACACAGACAG | 7901 |
| Chr_16_2 | TGAGAGGCCAAAGAATATCAGTTGACTCTGGATCAGGGGC | 7902 |
| Chr_16_3 | GAGGCTTTTTAGGGCAGCGAGAAAACGGGAACTTCATTCC | 7903 |
| Chr_16_4 | AGGACTTCTCTGGACCTGTGCCTCAACTACTCACCTGGAT | 7904 |
| Chr_16_5 | TGGCCACAAATGTTGCCTCCAGCTGCTCAATGTTCTCCAA | 7905 |
| Chr_16_6 | CTGGCATTGGTGAGTAATAGGAGCCAGACGGGTCTGTGTT | 7906 |

TABLE 3-continued

Chromosomal Control Probes

| Name | Sequence | SEQ ID NO: |
|---|---|---|
| Chr_16_7 | ATACTTACCTGCACGAGAATGAGTTTGGAGCGCAAGGGGG | 7907 |
| Chr_16_8 | TTCCCCCAGAGACTCTGTCCACTATGGACATTAAAATGTG | 7908 |
| Chr_16_9 | GTGCTACCCTCCTCCCTTCAGGTTATGTGGTCCAGGCTTT | 7909 |
| Chr_16_10 | TAAGTGGAACAACATTCCCTTCATTATAGCCCTTCGTGGG | 7910 |
| Chr_16_11 | GCAACGTCAACAACTACTACGTGCACAAGCGCCTCTACTG | 7911 |
| Chr_17_1 | GCGGATGTCGTTATGGGACAGGTACAAGTAGATAAGTTGC | 7912 |
| Chr_17_2 | GTGGTCACCATCTCTTCAAACCATTTGGACTGGGCCTGGT | 7913 |
| Chr_17_3 | AAGCCAAGGAGTTCTGAGAGAGCTTAGCTAAGTTCTTCGC | 7914 |
| Chr_17_4 | TTTTTTAGTACCCCAGTGTGTAAGACCAACTGAGGGTGGC | 7915 |
| Chr_17_5 | GTTGTCATTGGGGCTATAGACATAAGCACCTTCCGGAATC | 7916 |
| Chr_17_6 | CTGAGTGTGCGAGGGGAAGATATTGGTGAAGACCTGTTCT | 7917 |
| Chr_17_7 | GTCAGACCCTGTCCTCGTCTCCTTTACCTTGTCTCGATTT | 7918 |
| Chr_17_8 | TAAACTATGCTCGCCACCACTCAGCACTCACCTCTTGGGC | 7919 |
| Chr_17_9 | GGCAACTTCCTGAGACAGATCGGTAAAAACAACCCCTTCT | 7920 |
| Chr_17_10 | TCAACTGTATTTCATCAGAGAGATGTGGCTTTCCCAGACA | 7921 |
| Chr_17_11 | GTTTCCCTCATGTTCCCCCAGGTTCTGTCAGGTGAAGCTG | 7922 |
| Chr_18_1 | TTAACCCATCTCTACCCGTCCTGTGTCAAGAACGGAGGCT | 7923 |
| Chr_18_2 | CTGCCCAAAATAGAAACCGAGGTTCTCCGTGACCTACATC | 7924 |
| Chr_18_3 | TTCCTTTGCAGTAACAGCGGGAACATGAAGCCGCCACTCT | 7925 |
| Chr_18_4 | TGGTTTGCCAGTTCAGACACCCAGCCAAATTGCCCTCTCA | 7926 |
| Chr_18_5 | TAGTGCAGCTGGCTTTGAGCCTGTTCCCGAATGTTCAGAT | 7927 |
| Chr_18_6 | AGGGTAATAGCACCAAGCTCTAGTCTACCCACCTCTCTGA | 7928 |
| Chr_18_7 | CCGCATCTCTGGAGTAGGAATTGATCAGCCACCATATGGG | 7929 |
| Chr_18_8 | CTATGAGCATACTGGGGAGGGAAACCTCTAAGCGGAACTT | 7930 |
| Chr_18_9 | AAAAACCTGCAGGAAGGAGACCTGAATGCAACTGTGGGTC | 7931 |
| Chr_18_10 | CAGGTGCTCCAAACCTTCCAGTCTATGTTGTAGATTGCAG | 7932 |
| Chr_18_11 | GCCATACTAACCTACTTCTCCTTGAAGCTCTTGGCCCATC | 7933 |
| Chr_19_1 | ACTGTGAGATAGCCCTCATCATCTTCAACAGCGCCAACCG | 7934 |
| Chr_19_2 | AGATACACGGTCACAGACGCCATGTGTTGTGGCTTCTGCA | 7935 |
| Chr_19_3 | CACATCCTCTCACCTTTTCCGAAGGTTGCAGCTCCTTCTC | 7936 |
| Chr_19_4 | TCTGTCTCACCGGTCCCTTCATTCCTAGGCAACTGTAGAT | 7937 |
| Chr_19_5 | ATATCATGGTCTGTATCCCCCAGGTACCTTGACACAGGCC | 7938 |
| Chr_19_6 | CTCTCCGCCTTTCTTTAGACCTGAGCATGCAGAATTCCGA | 7939 |
| Chr_19_7 | AAGGCATTTAAATGGGACAGCGTCCCATGCGTGACTTCTC | 7940 |
| Chr_19_8 | TCTTTCTAACAGACGAACAGCCTACACCTACAACCCCGAG | 7941 |
| Chr_19_9 | GTCCCAGCCCAAAAGCATCTTGGGTAAGGATTTGGGATCA | 7942 |
| Chr_19_10 | GTTGTTCTGGGCCAGTGTTAGTTGCTCACATGTCCTGTCT | 7943 |
| Chr_19_11 | AACATGCCTCTTAGTCCTGGGCCATACCTTAGCCTTGTGC | 7944 |

TABLE 3-continued

Chromosomal Control Probes

| Name | Sequence | SEQ ID NO: |
|---|---|---|
| Chr_20_1 | TAACCTCCAAAAGAGGTACCCATTGGCGCTCAACCGAATT | 7945 |
| Chr_20_2 | CTATATCTCCGACTATGCCTTCTTGGGCACTGCACTGCTG | 7946 |
| Chr_20_3 | TCTAGATGGAAGCTGTATCCAAGGATGCTCCGGAATGTTG | 7947 |
| Chr_20_4 | ATCTTCTCTGCCTGCCGCACTAGCTTCTTGGTGACTTCTC | 7948 |
| Chr_20_5 | ATCGAGTTGTCGAGCCCCATGATTCGACACCAAGATCCCA | 7949 |
| Chr_20_6 | AGGTGCTTGTTTTACTCTCTCCAGGTGATGATGCCAGGGA | 7950 |
| Chr_20_7 | GTGCACTGTCAGATCTTGGAAACGGCCAAAGGATTTTTCC | 7951 |
| Chr_20_8 | CATTTTGCAGGAGGCTGCTAATTAAGGCTGAGGGCCATCA | 7952 |
| Chr_20_9 | TCAATGGTAGACTGGAGTACCTTGCCAGGGCAGAGAAAAA | 7953 |
| Chr_20_10 | CTCCTCCAGGAGCTGGCAGCATCAAGACCCCACTTCGCTT | 7954 |
| Chr_21_1 | AAATAATAGCAGGCGTTGAGATGTCCCTTCCCCAGCACTC | 7955 |
| Chr_21_2 | AAGTCTGACAGCATCTGCTTGAACTGAGGCACAGTGATGG | 7956 |
| Chr_21_3 | ATTCGTGATGGCGCTCATTTCCATAAAGGACGACAGGTCA | 7957 |
| Chr_21_4 | GAAGAGTGAATTCCCGCTTCTGCGCCAACATTCTGTTTCC | 7958 |
| Chr_21_5 | ACAGGTGAAGTCTTTGCGTGCCTCCCTGTTGGACTCAAAT | 7959 |
| Chr_21_6 | TAATGATATTCTGGCACAAGGAGCAGAGCCCCTCTTCTTC | 7960 |
| Chr_21_7 | AGACCCAGCCTACCTGCATGATCTCTTGTACAGCTTTGCA | 7961 |
| Chr_21_8 | TCATGGAACATGGGCCTTGCAAAGGGGTCAAGATCACAAC | 7962 |
| Chr_21_9 | GTCAAAAAGGTCCAATCAGCTAGAGACTAGGCCAGACCCA | 7963 |
| Chr_22_1 | TGTGACCACCCTAAAGGGAGGGCAGAAGCCGAGTCACCCT | 7964 |
| Chr_22_2 | ACGCCTCCACCTGCTGCTAGGACTCCCCTCCCAAACAAAG | 7965 |
| Chr_22_3 | CACAGTCTAGACCCTGATGGGCGATCTCAGTAGTGCTGTT | 7966 |
| Chr_22_4 | CCTATCAACGTGCAAGTGGGATTTGTCTCCACTGGCTTTC | 7967 |
| Chr_22_5 | GAAAATCATTCCCCATTCTGCAGGATCCGTTCCCCTGGCA | 7968 |
| Chr_22_6 | AGTGGGACATACCAACTTGATGAGGCAGTTGTGCGAGTTC | 7969 |
| Chr_22_7 | GTAAACAGCTGTCTTCTTACCCTACAGATCATTGGGCAGG | 7970 |
| Chr_22_8 | CAGAAGGATACTAGAATGGAATGTCCTGCGTGACGAAAGC | 7971 |
| Chr_22_9 | AGTTCACATCTGATTCTCCTATGGCTGCTAGGCTCCAGGA | 7972 |

Figure 27C:
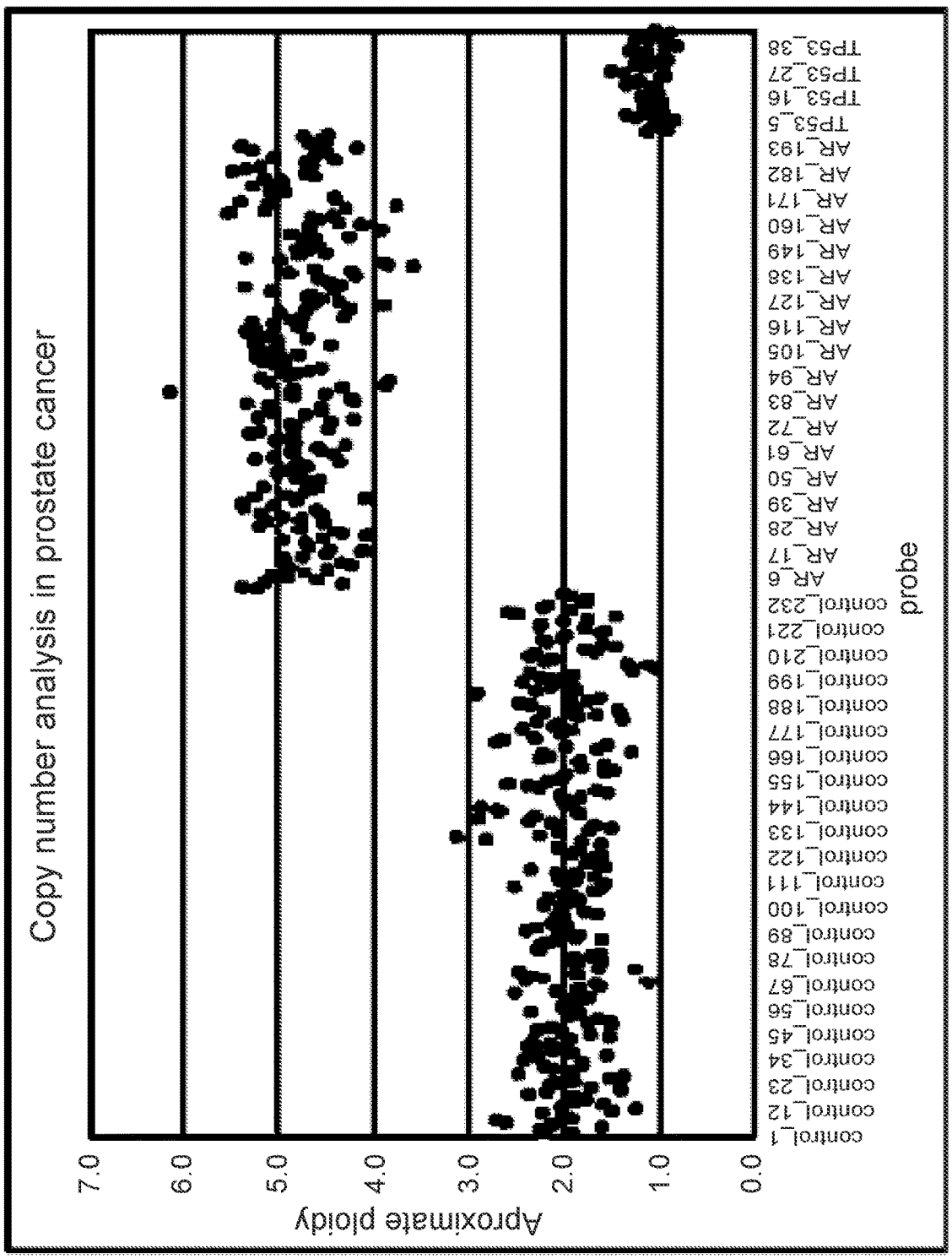

Significantly, when the same analysis was applied to cfDNA collected from the blood plasma fraction of a castration-resistant prostate cancer patient using healthy samples as normalization controls, three prominent features emerged (FIG. 27C). First, all of the control probes exhibited noisy counting behavior. Second, the counts across all AR probes were significantly elevated from a normal value of "1" to an amplified value of approximately "5". Amplification of the AR gene is consistently observed in advanced prostate cancer patients. Third, the TP53 probe counts, while more tightly clustered, possessed an average value far closer to "1" than the expected value of "2." This likely reflected inactivation of one or both alleles of TP53 by copy number loss in the fraction of circulating DNA derived from tumor tissue.

These data indicated that the methods of the present invention comprise three important karyotyping aspects. Namely, the methods described herein detect generalized chromosomal aneuploidy, copy increases of specific, targeted genes, and copy losses in the same specific, targeted genes. These result further indicate that the methods and platforms described herein can guide the use of precision therapies, as all three of these genomic abnormalities occur frequently in cancer.

Figure 28:
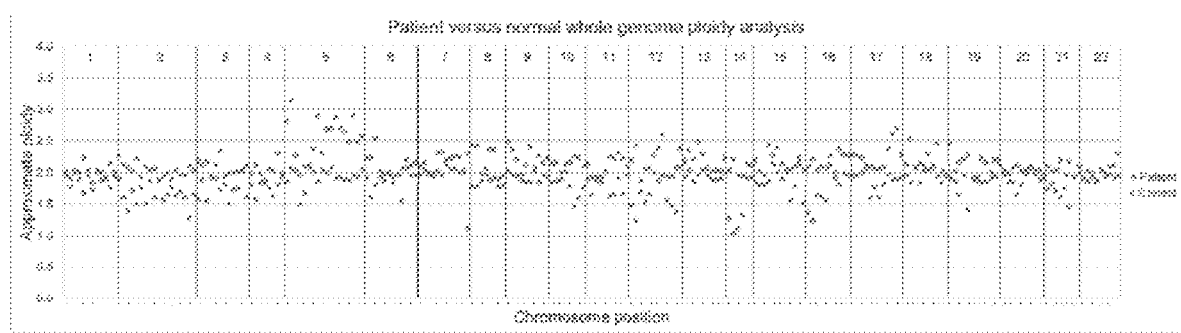
FIG. 28 shows whole genome aneuploidy analysis of a prostate patient cfDNA library relative to a control sample. The approximate ploidy for each of 239 control probes is shown sorted by chromosome. Patient chromosome 2 probes show consistent copy loss and the majority of chromosome 5 probes show copy gain. Significant deviation of approximate ploidy are seen for many, but not all, of the patient control probes.

Generalized chromosomal aneuploidy for castration-resistant prostate cancer patient samples (blue dots) relative to a healthy control (brown dots) was measured (FIG. 28). In this analysis, the approximate ploidy for all 239 control probes used in the experiment were ordered according to their chromosomal targets. For some chromosomes (e.g., chromosome 1 and chromosome 22) a similar ploidy value of "2" was observed between patient and control samples. In other cases, deviation between the two samples was observed. The degree of information regarding overall genomic ploidy provided by these experiments was constrained by the number and density of control probes used. However, these data indicate that a denser probe panel covering all chromosomal segments at uniform density can be used—in conjunction with the additional unique features of the present invention. Such analyses will provide a higher resolution, genome-wide measurement of chromosomal copy number.

These data further highlight the capabilities of the present invention as a guide for precision therapy. For example, tumors that possess genomic deficiencies in homologous recombination repair often exhibit highly destabilized chromosomal ploidies, and patients with such tumors are good candidates for inhibitors of the PARP enzyme complex (See Popova et al., Genome Biol. 2009; 10(11):R128). Unlike most sequencing assays that seek to genotype a tumor, the assays described herein use sequencing to detect destabilized chromosomal ploidy as a tumor phenotype, even if the causal mutations driving this phenotype remain hidden from targeted analysis.

Figure 29:
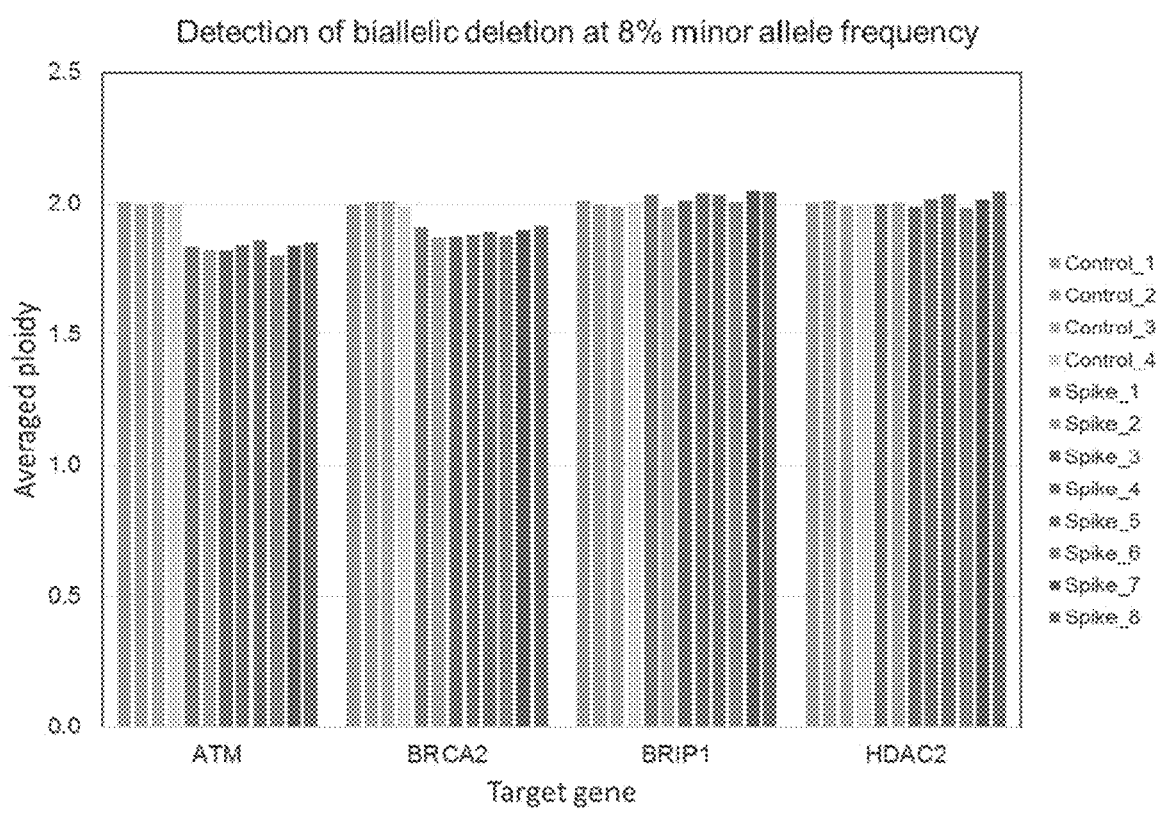
FIG. 29 shows analytical validation of copy number loss detection. Genomic DNA from immortalized line NA02718 (monoallelic ΔATM) and from NA09596 (monoallelic ΔBRCA2) were spiked into the "gold standard" genomic DNA from NA12878 at 16%, resulting in the equivalent of an 8% biallelic deletion minor allele frequency. Following targeted sequencing and CNV analysis, the probe-by-probe ploidies were averaged for the two target genes. Two unperturbed control genes, BRIP1 and HDAC2, are shown for comparison.

The ability to detect gene loss in DNA shed from solid tumors is especially significant. Mutation and deletion of tumor suppressor genes is a frequent event in cancer genomes; moreover, individuals with germline loss of tumor suppressor genes are uniquely vulnerable to developing cancer later in life. The diagnostic value of a liquid biopsy copy number loss (CNL) assay is directly proportional to its sensitivity. To determine the lower limit of detection for the invention described here, the immortalized lines described in Example 1 were systematically diluted into the "genome-in-a-bottle" reference cell line, NA12878. One line had a single copy deletion (monoallelic loss) of ATM, the other a single copy deletion of BRCA2. The experiment included four control samples of pure NA12878 and eight spike-in samples containing 16% of each monoallelic deletion line (FIG. 29). For reporting purposes, this corresponds to an 8% minor allele frequency of biallelic loss. Averaged values for all probes targeting specific genes and two additional, undeleted control genes are shown in FIG. 29. Copy loss of ATM and BRCA2 was confined to spike-in samples only. Additional computational treatment of the data revealed confident copy loss calling of biallelic deletions down to 2% minor allele frequencies. This sensitivity indicated that the present invention required no specialized considerations in order to routinely include copy loss calls in standard blood-based genotyping assays.

These data demonstrate the use of probe-specific genomic capture data for the analysis of copy number, including both copy number gain and copy number loss of target genomic loci. Additionally, the invention described herein has been shown to possess the sensitive ability to detect single nucleotide variants, insertions and deletions ranging from single nucleotides to many thousands of base pairs, and gene fusions resulting from chromosomal rearrangement by aberrant mutational processes (See PCT Publication No. WO 2016/028316; and U.S. Patent Publication No. 2014-0274731). All of these mutational processes can contribute to the transformation of normal tissue to neoplastic cancers, and as precision therapies continue to emerge, accurate diagnosis of these diseased genomic signatures will become an increasingly indispensable feature of precision medicine.

SEQUENCE LISTING (7972 sequences)

SEQ ID NO: 1 - DNA, 10 bp, Artificial Sequence
  Synthesized partner strand oLigation strand
gtatgccaaa

SEQ ID NO: 2 - DNA, 10 bp, Artificial Sequence
  Synthesized partner strand oLigation strand
agcgttaccc

SEQ ID NO: 3 - DNA, 10 bp, Artificial Sequence
  Synthesized partner strand oLigation strand
tcgacatggg

SEQ ID NO: 4 - DNA, 10 bp, Artificial Sequence
  Synthesized partner strand oLigation strand
catcaggttt

SEQ ID NO: 5 - DNA, 10 bp, Artificial Sequence
  Synthesized ligation strand oligo
tggcatacgt

SEQ ID NO: 6 - DNA, 10 bp, Artificial Sequence
  Synthesized ligation strand oligo
gtaacgctag

SEQ ID NO: 7 - DNA, 10 bp, Artificial Sequence
  Synthesized ligation strand oligo
catgtcgatc

SEQ ID NO: 8 - DNA, 10 bp, Artificial Sequence
  Synthesized ligation strand oligo
acctgatgca

SEQ ID NO: 9 - DNA, 46 bp, Artificial Sequence
  Synthesized adaptor oligonucleotide
  misc_feature (34)..(36): n is a, c, g, or t
tgcaggaccagagaattcgaatacacgagcttannnacgtatgcca

SEQ ID NO: 10 - DNA, 46 bp, Artificial Sequence
  Synthesized adaptor oligonucleotide
  misc_feature (34)..(36): n is a, c, g, or t
tgcaggaccagagaattcgaatacattgctcacnnnacgtatgcca

SEQ ID NO: 11 - DNA, 46 bp, Artificial Sequence
  Synthesized adaptor oligonucleotide
  misc_feature (34)..(36): n is a, c, g, or t
tgcaggaccagagaattcgaatacataatacacnnnacgtatgcca

SEQ ID NO: 12 - DNA, 46 bp, Artificial Sequence
  Synthesized adaptor oligonucleotide
  misc_feature (34)..(36): n is a, c, g, or t
tgcaggaccagagaattcgaatacatcagcatgnnnacgtatgcca

SEQ ID NO: 13 - DNA, 46 bp, Artificial Sequence
  Synthesized adaptor oligonucleotide
  misc_feature (34)..(36): n is a, c, g, or t
tgcaggaccagagaattcgaatacaactgtagcnnnacgtatgcca

SEQ ID NO: 14 - DNA, 46 bp, Artificial Sequence
  Synthesized adaptor oligonucleotide
  misc_feature (34)..(36): n is a, c, g, or t
tgcaggaccagagaattcgaatacaattatgcannnacgtatgcca

SEQ ID NO: 15 - DNA, 46 bp, Artificial Sequence
  Synthesized adaptor oligonucleotide
  misc_feature (34)..(36): n is a, c, g, or t
tgcaggaccagagaattcgaatacatgaccttcnnnacgtatgcca

SEQ ID NO: 16 - DNA, 46 bp, Artificial Sequence
  Synthesized adaptor oligonucleotide
  misc_feature (34)..(36): n is a, c, g, or t
tgcaggaccagagaattcgaatacaaaaatcctnnnacgtatgcca

SEQ ID NO: 17 - DNA, 46 bp, Artificial Sequence
  Synthesized adaptor oligonucleotide
  misc_feature (34)..(36): n is a, c, g, or t
tgcaggaccagagaattcgaatacaggttccggnnnacgtatgcca

SEQ ID NO: 18 - DNA, 46 bp, Artificial Sequence
  Synthesized adaptor oligonucleotide
  misc_feature (34)..(36): n is a, c, g, or t
tgcaggaccagagaattcgaatacaacgtgcatnnnacgtatgcca

SEQ ID NO: 19 - DNA, 46 bp, Artificial Sequence
  Synthesized adaptor oligonucleotide
  misc_feature (34)..(36): n is a, c, g, or t
tgcaggaccagagaattcgaatacacgccccatnnnacgtatgcca

SEQ ID NO: 20 - DNA, 46 bp, Artificial Sequence
  Synthesized adaptor oligonucleotide
  misc_feature (34)..(36): n is a, c, g, or t
tgcaggaccagagaattcgaatacagtaagcctnnnacgtatgcca

SEQ ID NO: 21 - DNA, 46 bp, Artificial Sequence
  Synthesized adaptor oligonucleotide
  misc_feature (34)..(36): n is a, c, g, or t
tgcaggaccagagaattcgaatacaagtaatagnnnacgtatgcca

SEQ ID NO: 22 - DNA, 46 bp, Artificial Sequence
  Synthesized adaptor oligonucleotide
  misc_feature (34)..(36): n is a, c, g, or t
tgcaggaccagagaattcgaatacaaagtcccannnacgtatgcca

SEQ ID NO: 23 - DNA, 46 bp, Artificial Sequence
  Synthesized adaptor oligonucleotide
  misc_feature (34)..(36): n is a, c, g, or t
tgcaggaccagagaattcgaatacaagtgcatcnnnacgtatgcca

SEQ ID NO: 24 - DNA, 46 bp, Artificial Sequence
  Synthesized adaptor oligonucleotide
  misc_feature (34)..(36): n is a, c, g, or t
tgcaggaccagagaattcgaatacagacatattnnnacgtatgcca

SEQ ID NO: 25 - DNA, 46 bp, Artificial Sequence
  Synthesized adaptor oligonucleotide
  misc_feature (34)..(36): n is a, c, g, or t
tgcaggaccagagaattcgaatacagtccacaannnacgtatgcca

SEQ ID NO: 26 - DNA, 46 bp, Artificial Sequence
  Synthesized adaptor oligonucleotide
  misc_feature (34)..(36): n is a, c, g, or t
tgcaggaccagagaattcgaatacatctcagagnnnacgtatgcca

SEQ ID NO: 27 - DNA, 46 bp, Artificial Sequence
  Synthesized adaptor oligonucleotide
  misc_feature (34)..(36): n is a, c, g, or t
tgcaggaccagagaattcgaatacaaaaacgtannnacgtatgcca

SEQ ID NO: 28 - DNA, 46 bp, Artificial Sequence
  Synthesized adaptor oligonucleotide
  misc_feature (34)..(36): n is a, c, g, or t
tgcaggaccagagaattcgaatacactaccaagnnnacgtatgcca

SEQ ID NO: 29 - DNA, 46 bp, Artificial Sequence
  Synthesized adaptor oligonucleotide
  misc_feature (34)..(36): n is a, c, g, or t
tgcaggaccagagaattcgaatacacctgacttnnnacgtatgcca

SEQ ID NO: 30 - DNA, 46 bp, Artificial Sequence
  Synthesized adaptor oligonucleotide
  misc_feature (34)..(36): n is a, c, g, or t
tgcaggaccagagaattcgaatacactcctatgnnnacgtatgcca

SEQ ID NO: 31 - DNA, 46 bp, Artificial Sequence
  Synthesized adaptor oligonucleotide
  misc_feature (34)..(36): n is a, c, g, or t
tgcaggaccagagaattcgaatacaatcatgatnnnacgtatgcca

SEQ ID NO: 32 - DNA, 46 bp, Artificial Sequence
  Synthesized adaptor oligonucleotide
  misc_feature (34)..(36): n is a, c, g, or t
tgcaggaccagagaattcgaatacatgacggttnnnacgtatgcca

SEQ ID NO: 33 - DNA, 46 bp, Artificial Sequence
  Synthesized adaptor oligonucleotide
  misc_feature (34)..(36): n is a, c, g, or t
tgcaggaccagagaattcgaatacagtcggcgtnnnacgtatgcca

SEQ ID NO: 34 - DNA, 46 bp, Artificial Sequence
  Synthesized adaptor oligonucleotide
  misc_feature (34)..(36): n is a, c, g, or t
tgcaggaccagagaattcgaatacagttaccctnnnacgtatgcca

SEQ ID NO: 35 - DNA, 46 bp, Artificial Sequence
  Synthesized adaptor oligonucleotide
  misc_feature (34)..(36): n is a, c, g, or t
tgcaggaccagagaattcgaatacacttaacggnnnacgtatgcca

SEQ ID NO: 36 - DNA, 46 bp, Artificial Sequence
  Synthesized adaptor oligonucleotide
  misc_feature (34)..(36): n is a, c, g, or t
tgcaggaccagagaattcgaatacacgctcctgnnnacgtatgcca

SEQ ID NO: 37 - DNA, 46 bp, Artificial Sequence
  Synthesized adaptor oligonucleotide
  misc_feature (34)..(36): n is a, c, g, or t
tgcaggaccagagaattcgaatacatctcggttnnnacgtatgcca

SEQ ID NO: 38 - DNA, 46 bp, Artificial Sequence
  Synthesized adaptor oligonucleotide
  misc_feature (34)..(36): n is a, c, g, or t
tgcaggaccagagaattcgaatacagctcgagcnnnacgtatgcca

SEQ ID NO: 39 - DNA, 46 bp, Artificial Sequence
  Synthesized adaptor oligonucleotide
  misc_feature (34)..(36): n is a, c, g, or t
tgcaggaccagagaattcgaatacacgcttcgcnnnacgtatgcca

SEQ ID NO: 40 - DNA, 46 bp, Artificial Sequence
  Synthesized adaptor oligonucleotide
  misc_feature (34)..(36): n is a, c, g, or t
tgcaggaccagagaattcgaatacaatccagacnnnacgtatgcca

SEQ ID NO: 41 - DNA, 46 bp, Artificial Sequence
  Synthesized adaptor oligonucleotide
  misc_feature (34)..(36): n is a, c, g, or t
tgcaggaccagagaattcgaatacatagcactgnnnacgtatgcca

SEQ ID NO: 42 - DNA, 46 bp, Artificial Sequence
  Synthesized adaptor oligonucleotide
  misc_feature (34)..(36): n is a, c, g, or t
tgcaggaccagagaattcgaatacactggctttnnnacgtatgcca

SEQ ID NO: 43 - DNA, 46 bp, Artificial Sequence
  Synthesized adaptor oligonucleotide
  misc_feature (34)..(36): n is a, c, g, or t
tgcaggaccagagaattcgaatacagcaaatggnnnacgtatgcca

SEQ ID NO: 44 - DNA, 46 bp, Artificial Sequence
  Synthesized adaptor oligonucleotide
  misc_feature (34)..(36): n is a, c, g, or t
tgcaggaccagagaattcgaatacaggatgacannnacgtatgcca

SEQ ID NO: 45 - DNA, 46 bp, Artificial Sequence
  Synthesized adaptor oligonucleotide
  misc_feature (34)..(36): n is a, c, g, or t
tgcaggaccagagaattcgaatacagccccactnnnacgtatgcca

SEQ ID NO: 46 - DNA, 46 bp, Artificial Sequence
  Synthesized adaptor oligonucleotide
  misc_feature (34)..(36): n is a, c, g, or t
tgcaggaccagagaattcgaatacactagccggnnnacgtatgcca

SEQ ID NO: 47 - DNA, 46 bp, Artificial Sequence
  Synthesized adaptor oligonucleotide
  misc_feature (34)..(36): n is a, c, g, or t
tgcaggaccagagaattcgaatacaccctcctcnnnacgtatgcca

SEQ ID NO: 48 - DNA, 46 bp, Artificial Sequence
  Synthesized adaptor oligonucleotide
  misc_feature (34)..(36): n is a, c, g, or t
tgcaggaccagagaattcgaatacatgtagtgcnnnacgtatgcca

SEQ ID NO: 49 - DNA, 46 bp, Artificial Sequence
  Synthesized adaptor oligonucleotide
  misc_feature (34)..(36): n is a, c, g, or t
tgcaggaccagagaattcgaatacagaatgtggnnnacgtatgcca

SEQ ID NO: 50 - DNA, 46 bp, Artificial Sequence
  Synthesized adaptor oligonucleotide
  misc_feature (34)..(36): n is a, c, g, or t
tgcaggaccagagaattcgaatacaaatgatctnnnacgtatgcca

SEQ ID NO: 51 - DNA, 46 bp, Artificial Sequence
  Synthesized adaptor oligonucleotide
  misc_feature (34)..(36): n is a, c, g, or t
tgcaggaccagagaattcgaatacacactaacgnnnacgtatgcca

SEQ ID NO: 52 - DNA, 46 bp, Artificial Sequence
  Synthesized adaptor oligonucleotide
  misc_feature (34)..(36): n is a, c, g, or t
tgcaggaccagagaattcgaatacacgtcggacnnnacgtatgcca

SEQ ID NO: 53 - DNA, 46 bp, Artificial Sequence
  Synthesized adaptor oligonucleotide
  misc_feature (34)..(36): n is a, c, g, or t
tgcaggaccagagaattcgaatacagcaacttgnnnacgtatgcca

SEQ ID NO: 54 - DNA, 46 bp, Artificial Sequence
  Synthesized adaptor oligonucleotide
  misc_feature (34)..(36): n is a, c, g, or t
tgcaggaccagagaattcgaatacacggtggagnnnacgtatgcca

SEQ ID NO: 55 - DNA, 46 bp, Artificial Sequence
  Synthesized adaptor oligonucleotide
  misc_feature (34)..(36): n is a, c, g, or t
tgcaggaccagagaattcgaatacagtaaccgtnnnacgtatgcca

SEQ ID NO: 56 - DNA, 46 bp, Artificial Sequence
  Synthesized adaptor oligonucleotide
  misc_feature (34)..(36): n is a, c, g, or t
tgcaggaccagagaattcgaatacatagttttcnnnacgtatgcca

SEQ ID NO: 57 - DNA, 46 bp, Artificial Sequence
  Synthesized adaptor oligonucleotide
  misc_feature (34)..(36): n is a, c, g, or t
tgcaggaccagagaattcgaatacactgtcgttnnnacgtatgcca

SEQ ID NO: 58 - DNA, 46 bp, Artificial Sequence
  Synthesized adaptor oligonucleotide
  misc_feature (34)..(36): n is a, c, g, or t
tgcaggaccagagaattcgaatacattcgaggtnnnacgtatgcca

SEQ ID NO: 59 - DNA, 46 bp, Artificial Sequence
  Synthesized adaptor oligonucleotide
  misc_feature (34)..(36): n is a, c, g, or t
tgcaggaccagagaattcgaatacacctccacgnnnacgtatgcca

SEQ ID NO: 60 - DNA, 46 bp, Artificial Sequence
  Synthesized adaptor oligonucleotide
  misc_feature (34)..(36): n is a, c, g, or t
tgcaggaccagagaattcgaatacagagactagnnnacgtatgcca

SEQ ID NO: 61 - DNA, 46 bp, Artificial Sequence
  Synthesized adaptor oligonucleotide
  misc_feature (34)..(36): n is a, c, g, or t
tgcaggaccagagaattcgaatacatgaactatnnnacgtatgcca

SEQ ID NO: 62 - DNA, 46 bp, Artificial Sequence
  Synthesized adaptor oligonucleotide
  misc_feature (34)..(36): n is a, c, g, or t
tgcaggaccagagaattcgaatacagttgattannnacgtatgcca

SEQ ID NO: 63 - DNA, 46 bp, Artificial Sequence
  Synthesized adaptor oligonucleotide
  misc_feature (34)..(36): n is a, c, g, or t
tgcaggaccagagaattcgaatacatccactcannnacgtatgcca

SEQ ID NO: 64 - DNA, 46 bp, Artificial Sequence
  Synthesized adaptor oligonucleotide
  misc_feature (34)..(36): n is a, c, g, or t
tgcaggaccagagaattcgaatacagtgactgtnnnacgtatgcca

SEQ ID NO: 65 - DNA, 46 bp, Artificial Sequence
  Synthesized adaptor oligonucleotide
  misc_feature (34)..(36): n is a, c, g, or t
tgcaggaccagagaattcgaatacattacggcannnacgtatgcca

SEQ ID NO: 66 - DNA, 46 bp, Artificial Sequence
  Synthesized adaptor oligonucleotide
  misc_feature (34)..(36): n is a, c, g, or t
tgcaggaccagagaattcgaatacacacctccgnnnacgtatgcca

SEQ ID NO: 67 - DNA, 46 bp, Artificial Sequence
  Synthesized adaptor oligonucleotide
  misc_feature (34)..(36): n is a, c, g, or t
tgcaggaccagagaattcgaatacaaagaagaannnacgtatgcca

SEQ ID NO: 68 - DNA, 46 bp, Artificial Sequence
  Synthesized adaptor oligonucleotide
  misc_feature (34)..(36): n is a, c, g, or t
tgcaggaccagagaattcgaatacagaacctgtnnnacgtatgcca

SEQ ID NO: 69 - DNA, 46 bp, Artificial Sequence
  Synthesized adaptor oligonucleotide
  misc_feature (34)..(36): n is a, c, g, or t
tgcaggaccagagaattcgaatacagaataacannnctagcgttac

SEQ ID NO: 70 - DNA, 46 bp, Artificial Sequence
  Synthesized adaptor oligonucleotide
  misc_feature (34)..(36): n is a, c, g, or t
tgcaggaccagagaattcgaatacagcctcgtcnnnctagcgttac

SEQ ID NO: 71 - DNA, 46 bp, Artificial Sequence
  Synthesized adaptor oligonucleotide
  misc_feature (34)..(36): n is a, c, g, or t
tgcaggaccagagaattcgaatacacccgcactnnnctagcgttac

SEQ ID NO: 72 - DNA, 46 bp, Artificial Sequence
  Synthesized adaptor oligonucleotide
  misc_feature (34)..(36): n is a, c, g, or t
tgcaggaccagagaattcgaatacaccacgatannnctagcgttac

SEQ ID NO: 73 - DNA, 46 bp, Artificial Sequence
  Synthesized adaptor oligonucleotide
  misc_feature (34)..(36): n is a, c, g, or t
tgcaggaccagagaattcgaatacacggtacatnnnctagcgttac

SEQ ID NO: 74 - DNA, 46 bp, Artificial Sequence
  Synthesized adaptor oligonucleotide
  misc_feature (34)..(36): n is a, c, g, or t
tgcaggaccagagaattcgaatacaccatatccnnnctagcgttac

SEQ ID NO: 75 - DNA, 46 bp, Artificial Sequence
  Synthesized adaptor oligonucleotide
  misc_feature (34)..(36): n is a, c, g, or t
tgcaggaccagagaattcgaatacacatacggtnnnctagcgttac

SEQ ID NO: 76 - DNA, 46 bp, Artificial Sequence
  Synthesized adaptor oligonucleotide
  misc_feature (34)..(36): n is a, c, g, or t
tgcaggaccagagaattcgaatacaaatagcttnnnctagcgttac

SEQ ID NO: 77 - DNA, 46 bp, Artificial Sequence
  Synthesized adaptor oligonucleotide
  misc_feature (34)..(36): n is a, c, g, or t
tgcaggaccagagaattcgaatacaccaggtatnnnctagcgttac

SEQ ID NO: 78 - DNA, 46 bp, Artificial Sequence
  Synthesized adaptor oligonucleotide
  misc_feature (34)..(36): n is a, c, g, or t
tgcaggaccagagaattcgaatacacaacctgannnctagcgttac

SEQ ID NO: 79 - DNA, 46 bp, Artificial Sequence
  Synthesized adaptor oligonucleotide
  misc_feature (34)..(36): n is a, c, g, or t
tgcaggaccagagaattcgaatacatgatggtcnnnctagcgttac

SEQ ID NO: 80 - DNA, 46 bp, Artificial Sequence
  Synthesized adaptor oligonucleotide
  misc_feature (34)..(36): n is a, c, g, or t
tgcaggaccagagaattcgaatacaggagccgannnctagcgttac

SEQ ID NO: 81 - DNA, 46 bp, Artificial Sequence
  Synthesized adaptor oligonucleotide
  misc_feature (34)..(36): n is a, c, g, or t
tgcaggaccagagaattcgaatacaatgcggccnnnctagcgttac

SEQ ID NO: 82 - DNA, 46 bp, Artificial Sequence
  Synthesized adaptor oligonucleotide
  misc_feature (34)..(36): n is a, c, g, or t
tgcaggaccagagaattcgaatacatgctgtagnnnctagcgttac

SEQ ID NO: 83 - DNA, 46 bp, Artificial Sequence
  Synthesized adaptor oligonucleotide
  misc_feature (34)..(36): n is a, c, g, or t
tgcaggaccagagaattcgaatacagcattgacnnnctagcgttac

SEQ ID NO: 84 - DNA, 46 bp, Artificial Sequence
  Synthesized adaptor oligonucleotide
  misc_feature (34)..(36): n is a, c, g, or t
tgcaggaccagagaattcgaatacatttgtactnnnctagcgttac

SEQ ID NO: 85 - DNA, 46 bp, Artificial Sequence
  Synthesized adaptor oligonucleotide
  misc_feature (34)..(36): n is a, c, g, or t
tgcaggaccagagaattcgaatacacatatggcnnnctagcgttac

SEQ ID NO: 86 - DNA, 46 bp, Artificial Sequence
  Synthesized adaptor oligonucleotide
  misc_feature (34)..(36): n is a, c, g, or t
tgcaggaccagagaattcgaatacagcatgaagnnnctagcgttac

SEQ ID NO: 87 - DNA, 46 bp, Artificial Sequence
  Synthesized adaptor oligonucleotide
  misc_feature (34)..(36): n is a, c, g, or t
tgcaggaccagagaattcgaatacacaggaaacnnnctagcgttac

SEQ ID NO: 88 - DNA, 46 bp, Artificial Sequence
  Synthesized adaptor oligonucleotide
  misc_feature (34)..(36): n is a, c, g, or t
tgcaggaccagagaattcgaatacacctaagacnnnctagcgttac

SEQ ID NO: 89 - DNA, 46 bp, Artificial Sequence
  Synthesized adaptor oligonucleotide
  misc_feature (34)..(36): n is a, c, g, or t
tgcaggaccagagaattcgaatacaacctaggtnnnctagcgttac

SEQ ID NO: 90 - DNA, 46 bp, Artificial Sequence
  Synthesized adaptor oligonucleotide
  misc_feature (34)..(36): n is a, c, g, or t
tgcaggaccagagaattcgaatacaccattgtcnnnctagcgttac

SEQ ID NO: 91 - DNA, 46 bp, Artificial Sequence
  Synthesized adaptor oligonucleotide
  misc_feature (34)..(36): n is a, c, g, or t
tgcaggaccagagaattcgaatacatcggtttcnnnctagcgttac

SEQ ID NO: 92 - DNA, 46 bp, Artificial Sequence
  Synthesized adaptor oligonucleotide
  misc_feature (34)..(36): n is a, c, g, or t
tgcaggaccagagaattcgaatacacacctgttnnnctagcgttac

SEQ ID NO: 93 - DNA, 46 bp, Artificial Sequence
  Synthesized adaptor oligonucleotide
  misc_feature (34)..(36): n is a, c, g, or t
tgcaggaccagagaattcgaatacaagagagagnnnctagcgttac

SEQ ID NO: 94 - DNA, 46 bp, Artificial Sequence
  Synthesized adaptor oligonucleotide
  misc_feature (34)..(36): n is a, c, g, or t
tgcaggaccagagaattcgaatacaatggcccgnnnctagcgttac

SEQ ID NO: 95 - DNA, 46 bp, Artificial Sequence
  Synthesized adaptor oligonucleotide
  misc_feature (34)..(36): n is a, c, g, or t
tgcaggaccagagaattcgaatacatagcgtgtnnnctagcgttac

SEQ ID NO: 96 - DNA, 46 bp, Artificial Sequence
  Synthesized adaptor oligonucleotide
  misc_feature (34)..(36): n is a, c, g, or t
tgcaggaccagagaattcgaatacagaagacacnnnctagcgttac

SEQ ID NO: 97 - DNA, 46 bp, Artificial Sequence
  Synthesized adaptor oligonucleotide
  misc_feature (34)..(36): n is a, c, g, or t
tgcaggaccagagaattcgaatacatcatttgtnnnctagcgttac

SEQ ID NO: 98 - DNA, 46 bp, Artificial Sequence
  Synthesized adaptor oligonucleotide
  misc_feature (34)..(36): n is a, c, g, or t
tgcaggaccagagaattcgaatacatcgaacacnnnctagcgttac

SEQ ID NO: 99 - DNA, 46 bp, Artificial Sequence
  Synthesized adaptor oligonucleotide
  misc_feature (34)..(36): n is a, c, g, or t
tgcaggaccagagaattcgaatacaagcttacgnnnctagcgttac

SEQ ID NO: 100 - DNA, 46 bp, Artificial Sequence
  Synthesized adaptor oligonucleotide
  misc_feature (34)..(36): n is a, c, g, or t
tgcaggaccagagaattcgaatacactcggtttnnnctagcgttac

SEQ ID NO: 101 - DNA, 46 bp, Artificial Sequence
  Synthesized adaptor oligonucleotide
  misc_feature (34)..(36): n is a, c, g, or t
tgcaggaccagagaattcgaatacaaatcgttannnctagcgttac

SEQ ID NO: 102 - DNA, 46 bp, Artificial Sequence
  Synthesized adaptor oligonucleotide
  misc_feature (34)..(36): n is a, c, g, or t
tgcaggaccagagaattcgaatacataacagttnnnctagcgttac

SEQ ID NO: 103 - DNA, 46 bp, Artificial Sequence
  Synthesized adaptor oligonucleotide
  misc_feature (34)..(36): n is a, c, g, or t
tgcaggaccagagaattcgaatacaatcctgtcnnnctagcgttac

SEQ ID NO: 104 - DNA, 46 bp, Artificial Sequence
  Synthesized adaptor oligonucleotide
  misc_feature (34)..(36): n is a, c, g, or t
tgcaggaccagagaattcgaatacagtaatgttnnnctagcgttac

SEQ ID NO: 105 - DNA, 46 bp, Artificial Sequence
  Synthesized adaptor oligonucleotide
  misc_feature (34)..(36): n is a, c, g, or t
tgcaggaccagagaattcgaatacattgcgcggnnnctagcgttac

SEQ ID NO: 106 - DNA, 46 bp, Artificial Sequence
  Synthesized adaptor oligonucleotide
  misc_feature (34)..(36): n is a, c, g, or t
tgcaggaccagagaattcgaatacagtcaggaannnctagcgttac

SEQ ID NO: 107 - DNA, 46 bp, Artificial Sequence
  Synthesized adaptor oligonucleotide
  misc_feature (34)..(36): n is a, c, g, or t
tgcaggaccagagaattcgaatacagttaaaagnnnctagcgttac

SEQ ID NO: 108 - DNA, 46 bp, Artificial Sequence
  Synthesized adaptor oligonucleotide
  misc_feature (34)..(36): n is a, c, g, or t
tgcaggaccagagaattcgaatacatgtcataannnctagcgttac

SEQ ID NO: 109 - DNA, 46 bp, Artificial Sequence
  Synthesized adaptor oligonucleotide
  misc_feature (34)..(36): n is a, c, g, or t
tgcaggaccagagaattcgaatacaacttgaatnnnctagcgttac

SEQ ID NO: 110 - DNA, 46 bp, Artificial Sequence
  Synthesized adaptor oligonucleotide
  misc_feature (34)..(36): n is a, c, g, or t
tgcaggaccagagaattcgaatacatgtggcatnnnctagcgttac

SEQ ID NO: 111 - DNA, 46 bp, Artificial Sequence
  Synthesized adaptor oligonucleotide
  misc_feature (34)..(36): n is a, c, g, or t
tgcaggaccagagaattcgaatacatctacaccnnnctagcgttac

SEQ ID NO: 112 - DNA, 46 bp, Artificial Sequence
  Synthesized adaptor oligonucleotide
  misc_feature (34)..(36): n is a, c, g, or t
tgcaggaccagagaattcgaatacatcatgcctnnnctagcgttac

SEQ ID NO: 113 - DNA, 46 bp, Artificial Sequence
  Synthesized adaptor oligonucleotide
  misc_feature (34)..(36): n is a, c, g, or t
tgcaggaccagagaattcgaatacatctagcctnnnctagcgttac

SEQ ID NO: 114 - DNA, 46 bp, Artificial Sequence
  Synthesized adaptor oligonucleotide
  misc_feature (34)..(36): n is a, c, g, or t
tgcaggaccagagaattcgaatacaataaagcannnctagcgttac

SEQ ID NO: 115 - DNA, 46 bp, Artificial Sequence
  Synthesized adaptor oligonucleotide
  misc_feature (34)..(36): n is a, c, g, or t
tgcaggaccagagaattcgaatacatgcataatnnnctagcgttac

SEQ ID NO: 116 - DNA, 46 bp, Artificial Sequence
  Synthesized adaptor oligonucleotide
  misc_feature (34)..(36): n is a, c, g, or t
tgcaggaccagagaattcgaatacacatgacgtnnnctagcgttac

SEQ ID NO: 117 - DNA, 46 bp, Artificial Sequence
  Synthesized adaptor oligonucleotide
  misc_feature (34)..(36): n is a, c, g, or t
tgcaggaccagagaattcgaatacacttatcatnnnctagcgttac

SEQ ID NO: 118 - DNA, 46 bp, Artificial Sequence
  Synthesized adaptor oligonucleotide
  misc_feature (34)..(36): n is a, c, g, or t
tgcaggaccagagaattcgaatacacggcctgannnctagcgttac

SEQ ID NO: 119 - DNA, 46 bp, Artificial Sequence
  Synthesized adaptor oligonucleotide
  misc_feature (34)..(36): n is a, c, g, or t
tgcaggaccagagaattcgaatacacgtcaatgnnnctagcgttac

SEQ ID NO: 120 - DNA, 46 bp, Artificial Sequence
  Synthesized adaptor oligonucleotide
  misc_feature (34)..(36): n is a, c, g, or t
tgcaggaccagagaattcgaatacacttatactnnnctagcgttac

SEQ ID NO: 121 - DNA, 46 bp, Artificial Sequence
  Synthesized adaptor oligonucleotide
  misc_feature (34)..(36): n is a, c, g, or t
tgcaggaccagagaattcgaatacaggaggtatnnnctagcgttac

SEQ ID NO: 122 - DNA, 46 bp, Artificial Sequence
  Synthesized adaptor oligonucleotide
  misc_feature (34)..(36): n is a, c, g, or t
tgcaggaccagagaattcgaatacaattgttctnnnctagcgttac

SEQ ID NO: 123 - DNA, 46 bp, Artificial Sequence
  Synthesized adaptor oligonucleotide
  misc_feature (34)..(36): n is a, c, g, or t
tgcaggaccagagaattcgaatacaaactccagnnnctagcgttac

SEQ ID NO: 124 - DNA, 46 bp, Artificial Sequence
  Synthesized adaptor oligonucleotide
  misc_feature (34)..(36): n is a, c, g, or t
tgcaggaccagagaattcgaatacacgaggtccnnnctagcgttac

SEQ ID NO: 125 - DNA, 46 bp, Artificial Sequence
  Synthesized adaptor oligonucleotide
  misc_feature (34)..(36): n is a, c, g, or t
tgcaggaccagagaattcgaatacacgcgaccannnctagcgttac

SEQ ID NO: 126 - DNA, 46 bp, Artificial Sequence
  Synthesized adaptor oligonucleotide
  misc_feature (34)..(36): n is a, c, g, or t
tgcaggaccagagaattcgaatacatgccgcctnnnctagcgttac

SEQ ID NO: 127 - DNA, 46 bp, Artificial Sequence
  Synthesized adaptor oligonucleotide
  misc_feature (34)..(36): n is a, c, g, or t
tgcaggaccagagaattcgaatacagttacgacnnnctagcgttac

SEQ ID NO: 128 - DNA, 46 bp, Artificial Sequence
  Synthesized adaptor oligonucleotide
  misc_feature (34)..(36): n is a, c, g, or t
tgcaggaccagagaattcgaatacattatcatcnnnctagcgttac

SEQ ID NO: 129 - DNA, 46 bp, Artificial Sequence
  Synthesized adaptor oligonucleotide
  misc_feature (34)..(36): n is a, c, g, or t
tgcaggaccagagaattcgaatacaccttctctnnngatcgacatg

SEQ ID NO: 130 - DNA, 46 bp, Artificial Sequence
  Synthesized adaptor oligonucleotide
  misc_feature (34)..(36): n is a, c, g, or t
tgcaggaccagagaattcgaatacaaacaggtgnnngatcgacatg

SEQ ID NO: 131 - DNA, 46 bp, Artificial Sequence
  Synthesized adaptor oligonucleotide
  misc_feature (34)..(36): n is a, c, g, or t
tgcaggaccagagaattcgaatacaacttgtccnnngatcgacatg

SEQ ID NO: 132 - DNA, 46 bp, Artificial Sequence
  Synthesized adaptor oligonucleotide
  misc_feature (34)..(36): n is a, c, g, or t
tgcaggaccagagaattcgaatacattggtaatnnngatcgacatg

SEQ ID NO: 133 - DNA, 46 bp, Artificial Sequence
  Synthesized adaptor oligonucleotide
  misc_feature (34)..(36): n is a, c, g, or t
tgcaggaccagagaattcgaatacaggactcgcnnngatcgacatg

SEQ ID NO: 134 - DNA, 46 bp, Artificial Sequence
  Synthesized adaptor oligonucleotide
  misc_feature (34)..(36): n is a, c, g, or t
tgcaggaccagagaattcgaatacatgcgtcaannngatcgacatg

SEQ ID NO: 135 - DNA, 46 bp, Artificial Sequence
  Synthesized adaptor oligonucleotide
  misc_feature (34)..(36): n is a, c, g, or t
tgcaggaccagagaattcgaatacacagaataannngatcgacatg

SEQ ID NO: 136 - DNA, 46 bp, Artificial Sequence
  Synthesized adaptor oligonucleotide
  misc_feature (34)..(36): n is a, c, g, or t
tgcaggaccagagaattcgaatacatccgaggcnnngatcgacatg

SEQ ID NO: 137 - DNA, 46 bp, Artificial Sequence
  Synthesized adaptor oligonucleotide
  misc_feature (34)..(36): n is a, c, g, or t
tgcaggaccagagaattcgaatacaatttcttgnnngatcgacatg

SEQ ID NO: 138 - DNA, 46 bp, Artificial Sequence
  Synthesized adaptor oligonucleotide
  misc_feature (34)..(36): n is a, c, g, or t
tgcaggaccagagaattcgaatacaacttgtaannngatcgacatg

SEQ ID NO: 139 - DNA, 46 bp, Artificial Sequence
  Synthesized adaptor oligonucleotide
  misc_feature (34)..(36): n is a, c, g, or t
tgcaggaccagagaattcgaatacacacggtgcnnngatcgacatg

SEQ ID NO: 140 - DNA, 46 bp, Artificial Sequence
  Synthesized adaptor oligonucleotide
  misc_feature (34)..(36): n is a, c, g, or t
tgcaggaccagagaattcgaatacaaactcggtnnngatcgacatg

SEQ ID NO: 141 - DNA, 46 bp, Artificial Sequence
  Synthesized adaptor oligonucleotide
  misc_feature (34)..(36): n is a, c, g, or t
tgcaggaccagagaattcgaatacagcctattcnnngatcgacatg

SEQ ID NO: 142 - DNA, 46 bp, Artificial Sequence
  Synthesized adaptor oligonucleotide
  misc_feature (34)..(36): n is a, c, g, or t
tgcaggaccagagaattcgaatacaccgctaaannngatcgacatg

SEQ ID NO: 143 - DNA, 46 bp, Artificial Sequence
  Synthesized adaptor oligonucleotide
  misc_feature (34)..(36): n is a, c, g, or t
tgcaggaccagagaattcgaatacagtgagatgnnngatcgacatg

SEQ ID NO: 144 - DNA, 46 bp, Artificial Sequence
  Synthesized adaptor oligonucleotide
  misc_feature (34)..(36): n is a, c, g, or t
tgcaggaccagagaattcgaatacatctctcagnnngatcgacatg

SEQ ID NO: 145 - DNA, 46 bp, Artificial Sequence
  Synthesized adaptor oligonucleotide
  misc_feature (34)..(36): n is a, c, g, or t
tgcaggaccagagaattcgaatacatctctagcnnngatcgacatg

SEQ ID NO: 146 - DNA, 46 bp, Artificial Sequence
  Synthesized adaptor oligonucleotide
  misc_feature (34)..(36): n is a, c, g, or t
tgcaggaccagagaattcgaatacacaagcgccnnngatcgacatg

SEQ ID NO: 147 - DNA, 46 bp, Artificial Sequence
  Synthesized adaptor oligonucleotide
  misc_feature (34)..(36): n is a, c, g, or t
tgcaggaccagagaattcgaatacaggcagtaannngatcgacatg

SEQ ID NO: 148 - DNA, 46 bp, Artificial Sequence
  Synthesized adaptor oligonucleotide
  misc_feature (34)..(36): n is a, c, g, or t
tgcaggaccagagaattcgaatacattggctgannngatcgacatg

SEQ ID NO: 149 - DNA, 46 bp, Artificial Sequence
  Synthesized adaptor oligonucleotide
  misc_feature (34)..(36): n is a, c, g, or t
tgcaggaccagagaattcgaatacaacagcgaannngatcgacatg

SEQ ID NO: 150 - DNA, 46 bp, Artificial Sequence
  Synthesized adaptor oligonucleotide
  misc_feature (34)..(36): n is a, c, g, or t
tgcaggaccagagaattcgaatacaaagtttcannngatcgacatg

SEQ ID NO: 151 - DNA, 46 bp, Artificial Sequence
  Synthesized adaptor oligonucleotide
  misc_feature (34)..(36): n is a, c, g, or t
tgcaggaccagagaattcgaatacacgctctatnnngatcgacatg

SEQ ID NO: 152 - DNA, 46 bp, Artificial Sequence
  Synthesized adaptor oligonucleotide
  misc_feature (34)..(36): n is a, c, g, or t
tgcaggaccagagaattcgaatacataggagtgnnngatcgacatg

SEQ ID NO: 153 - DNA, 46 bp, Artificial Sequence
  Synthesized adaptor oligonucleotide
  misc_feature (34)..(36): n is a, c, g, or t
tgcaggaccagagaattcgaatacatcagcacannngatcgacatg

SEQ ID NO: 154 - DNA, 46 bp, Artificial Sequence
  Synthesized adaptor oligonucleotide
  misc_feature (34)..(36): n is a, c, g, or t
tgcaggaccagagaattcgaatacacgaactacnnngatcgacatg

SEQ ID NO: 155 - DNA, 46 bp, Artificial Sequence
  Synthesized adaptor oligonucleotide
  misc_feature (34)..(36): n is a, c, g, or t
tgcaggaccagagaattcgaatacatactaaacnnngatcgacatg

SEQ ID NO: 156 - DNA, 46 bp, Artificial Sequence
  Synthesized adaptor oligonucleotide
  misc_feature (34)..(36): n is a, c, g, or t
tgcaggaccagagaattcgaatacaggtacaagnnngatcgacatg

SEQ ID NO: 157 - DNA, 46 bp, Artificial Sequence
  Synthesized adaptor oligonucleotide
  misc_feature (34)..(36): n is a, c, g, or t
tgcaggaccagagaattcgaatacaacaggcttnnngatcgacatg

SEQ ID NO: 158 - DNA, 46 bp, Artificial Sequence
  Synthesized adaptor oligonucleotide
  misc_feature (34)..(36): n is a, c, g, or t
tgcaggaccagagaattcgaatacagaaaccctnnngatcgacatg

SEQ ID NO: 159 - DNA, 46 bp, Artificial Sequence
  Synthesized adaptor oligonucleotide
  misc_feature (34)..(36): n is a, c, g, or t
tgcaggaccagagaattcgaatacatccgcattnnngatcgacatg

SEQ ID NO: 160 - DNA, 46 bp, Artificial Sequence
  Synthesized adaptor oligonucleotide
  misc_feature (34)..(36): n is a, c, g, or t
tgcaggaccagagaattcgaatacacaatctggnnngatcgacatg

SEQ ID NO: 161 - DNA, 46 bp, Artificial Sequence
  Synthesized adaptor oligonucleotide
  misc_feature (34)..(36): n is a, c, g, or t
tgcaggaccagagaattcgaatacaaccttaccnnngatcgacatg

SEQ ID NO: 162 - DNA, 46 bp, Artificial Sequence
  Synthesized adaptor oligonucleotide
  misc_feature (34)..(36): n is a, c, g, or t
tgcaggaccagagaattcgaatacagcggtctgnnngatcgacatg

SEQ ID NO: 163 - DNA, 46 bp, Artificial Sequence
  Synthesized adaptor oligonucleotide
  misc_feature (34)..(36): n is a, c, g, or t
tgcaggaccagagaattcgaatacaaatcacgcnnngatcgacatg

SEQ ID NO: 164 - DNA, 46 bp, Artificial Sequence
  Synthesized adaptor oligonucleotide
  misc_feature (34)..(36): n is a, c, g, or t
tgcaggaccagagaattcgaatacaaatagtagnnngatcgacatg

SEQ ID NO: 165 - DNA, 46 bp, Artificial Sequence
  Synthesized adaptor oligonucleotide
  misc_feature (34)..(36): n is a, c, g, or t
tgcaggaccagagaattcgaatacaggcatctannngatcgacatg

SEQ ID NO: 166 - DNA, 46 bp, Artificial Sequence
  Synthesized adaptor oligonucleotide
  misc_feature (34)..(36): n is a, c, g, or t
tgcaggaccagagaattcgaatacaagcgcctgnnngatcgacatg

SEQ ID NO: 167 - DNA, 46 bp, Artificial Sequence
  Synthesized adaptor oligonucleotide
  misc_feature (34)..(36): n is a, c, g, or t
tgcaggaccagagaattcgaatacagacccggtnnngatcgacatg

SEQ ID NO: 168 - DNA, 46 bp, Artificial Sequence
  Synthesized adaptor oligonucleotide
  misc_feature (34)..(36): n is a, c, g, or t
tgcaggaccagagaattcgaatacacggtaaagnnngatcgacatg

SEQ ID NO: 169 - DNA, 46 bp, Artificial Sequence
  Synthesized adaptor oligonucleotide
  misc_feature (34)..(36): n is a, c, g, or t
tgcaggaccagagaattcgaatacaaggatgcannngatcgacatg

SEQ ID NO: 170 - DNA, 46 bp, Artificial Sequence
  Synthesized adaptor oligonucleotide
  misc_feature (34)..(36): n is a, c, g, or t
tgcaggaccagagaattcgaatacattctggagnnngatcgacatg

SEQ ID NO: 171 - DNA, 46 bp, Artificial Sequence
  Synthesized adaptor oligonucleotide
  misc_feature (34)..(36): n is a, c, g, or t
tgcaggaccagagaattcgaatacagctcaaacnnngatcgacatg

SEQ ID NO: 172 - DNA, 46 bp, Artificial Sequence
  Synthesized adaptor oligonucleotide
  misc_feature (34)..(36): n is a, c, g, or t
tgcaggaccagagaattcgaatacataagttacnnngatcgacatg

SEQ ID NO: 173 - DNA, 46 bp, Artificial Sequence
  Synthesized adaptor oligonucleotide
  misc_feature (34)..(36): n is a, c, g, or t
tgcaggaccagagaattcgaatacacaacccttnnngatcgacatg

SEQ ID NO: 174 - DNA, 46 bp, Artificial Sequence
  Synthesized adaptor oligonucleotide
  misc_feature (34)..(36): n is a, c, g, or t
tgcaggaccagagaattcgaatacaccttccggnnngatcgacatg

SEQ ID NO: 175 - DNA, 46 bp, Artificial Sequence
  Synthesized adaptor oligonucleotide
  misc_feature (34)..(36): n is a, c, g, or t
tgcaggaccagagaattcgaatacagtgagagtnnngatcgacatg

SEQ ID NO: 176 - DNA, 46 bp, Artificial Sequence
  Synthesized adaptor oligonucleotide
  misc_feature (34)..(36): n is a, c, g, or t
tgcaggaccagagaattcgaatacagcgtccagnnngatcgacatg

SEQ ID NO: 177 - DNA, 46 bp, Artificial Sequence
  Synthesized adaptor oligonucleotide
  misc_feature (34)..(36): n is a, c, g, or t
tgcaggaccagagaattcgaatacatttattcgnnngatcgacatg

SEQ ID NO: 178 - DNA, 46 bp, Artificial Sequence
  Synthesized adaptor oligonucleotide
  misc_feature (34)..(36): n is a, c, g, or t
tgcaggaccagagaattcgaatacagtaataagnnngatcgacatg

SEQ ID NO: 179 - DNA, 46 bp, Artificial Sequence
  Synthesized adaptor oligonucleotide
  misc_feature (34)..(36): n is a, c, g, or t
tgcaggaccagagaattcgaatacatacaagccnnngatcgacatg

SEQ ID NO: 180 - DNA, 46 bp, Artificial Sequence
  Synthesized adaptor oligonucleotide
  misc_feature (34)..(36): n is a, c, g, or t
tgcaggaccagagaattcgaatacaaagccgaannngatcgacatg

SEQ ID NO: 181 - DNA, 46 bp, Artificial Sequence
  Synthesized adaptor oligonucleotide
  misc_feature (34)..(36): n is a, c, g, or t
tgcaggaccagagaattcgaatacaatactttcnnngatcgacatg

SEQ ID NO: 182 - DNA, 46 bp, Artificial Sequence
  Synthesized adaptor oligonucleotide
  misc_feature (34)..(36): n is a, c, g, or t
tgcaggaccagagaattcgaatacactggatcannngatcgacatg

SEQ ID NO: 183 - DNA, 46 bp, Artificial Sequence
  Synthesized adaptor oligonucleotide
  misc_feature (34)..(36): n is a, c, g, or t
tgcaggaccagagaattcgaatacaaacgcctannngatcgacatg

SEQ ID NO: 184 - DNA, 46 bp, Artificial Sequence
  Synthesized adaptor oligonucleotide
  misc_feature (34)..(36): n is a, c, g, or t
tgcaggaccagagaattcgaatacagtcgagaannngatcgacatg

SEQ ID NO: 185 - DNA, 46 bp, Artificial Sequence
  Synthesized adaptor oligonucleotide
  misc_feature (34)..(36): n is a, c, g, or t
tgcaggaccagagaattcgaatacataattctcnnngatcgacatg

SEQ ID NO: 186 - DNA, 46 bp, Artificial Sequence
  Synthesized adaptor oligonucleotide
  misc_feature (34)..(36): n is a, c, g, or t
tgcaggaccagagaattcgaatacataaccctcnnngatcgacatg

SEQ ID NO: 187 - DNA, 46 bp, Artificial Sequence
  Synthesized adaptor oligonucleotide
  misc_feature (34)..(36): n is a, c, g, or t
tgcaggaccagagaattcgaatacagcgcttggnnngatcgacatg

SEQ ID NO: 188 - DNA, 46 bp, Artificial Sequence
  Synthesized adaptor oligonucleotide
  misc_feature (34)..(36): n is a, c, g, or t
tgcaggaccagagaattcgaatacacggacaccnnngatcgacatg

SEQ ID NO: 189 - DNA, 46 bp, Artificial Sequence
  Synthesized adaptor oligonucleotide
  misc_feature (34)..(36): n is a, c, g, or t
tgcaggaccagagaattcgaatacatggaagtgnnntgcatcaggt

SEQ ID NO: 190 - DNA, 46 bp, Artificial Sequence
  Synthesized adaptor oligonucleotide
  misc_feature (34)..(36): n is a, c, g, or t
tgcaggaccagagaattcgaatacaaagtctatnnntgcatcaggt

SEQ ID NO: 191 - DNA, 46 bp, Artificial Sequence
  Synthesized adaptor oligonucleotide
  misc_feature (34)..(36): n is a, c, g, or t
tgcaggaccagagaattcgaatacaatgaatagnnntgcatcaggt

SEQ ID NO: 192 - DNA, 46 bp, Artificial Sequence
  Synthesized adaptor oligonucleotide
  misc_feature (34)..(36): n is a, c, g, or t
tgcaggaccagagaattcgaatacattctcctcnnntgcatcaggt

SEQ ID NO: 193 - DNA, 46 bp, Artificial Sequence
  Synthesized adaptor oligonucleotide
  misc_feature (34)..(36): n is a, c, g, or t
tgcaggaccagagaattcgaatacaccagccctnnntgcatcaggt

SEQ ID NO: 194 - DNA, 46 bp, Artificial Sequence
  Synthesized adaptor oligonucleotide
  misc_feature (34)..(36): n is a, c, g, or t
tgcaggaccagagaattcgaatacaaacaaaacnnntgcatcaggt

SEQ ID NO: 195 - DNA, 46 bp, Artificial Sequence
  Synthesized adaptor oligonucleotide
  misc_feature (34)..(36): n is a, c, g, or t
tgcaggaccagagaattcgaatacacgctcaccnnntgcatcaggt

SEQ ID NO: 196 - DNA, 46 bp, Artificial Sequence
  Synthesized adaptor oligonucleotide
  misc_feature (34)..(36): n is a, c, g, or t
tgcaggaccagagaattcgaatacatggtgatcnnntgcatcaggt

SEQ ID NO: 197 - DNA, 46 bp, Artificial Sequence
  Synthesized adaptor oligonucleotide
  misc_feature (34)..(36): n is a, c, g, or t
tgcaggaccagagaattcgaatacagttgctagnnntgcatcaggt

SEQ ID NO: 198 - DNA, 46 bp, Artificial Sequence
  Synthesized adaptor oligonucleotide
  misc_feature (34)..(36): n is a, c, g, or t
tgcaggaccagagaattcgaatacatcaccctannntgcatcaggt

SEQ ID NO: 199 - DNA, 46 bp, Artificial Sequence
  Synthesized adaptor oligonucleotide
  misc_feature (34)..(36): n is a, c, g, or t
tgcaggaccagagaattcgaatacagactctgannntgcatcaggt

SEQ ID NO: 200 - DNA, 46 bp, Artificial Sequence
  Synthesized adaptor oligonucleotide
  misc_feature (34)..(36): n is a, c, g, or t
tgcaggaccagagaattcgaatacacgtatgacnnntgcatcaggt

SEQ ID NO: 201 - DNA, 46 bp, Artificial Sequence
  Synthesized adaptor oligonucleotide
  misc_feature (34)..(36): n is a, c, g, or t
tgcaggaccagagaattcgaatacatgcaccggnnntgcatcaggt

SEQ ID NO: 202 - DNA, 46 bp, Artificial Sequence
  Synthesized adaptor oligonucleotide
  misc_feature (34)..(36): n is a, c, g, or t
tgcaggaccagagaattcgaatacaactgatgcnnntgcatcaggt

SEQ ID NO: 203 - DNA, 46 bp, Artificial Sequence
  Synthesized adaptor oligonucleotide
  misc_feature (34)..(36): n is a, c, g, or t
tgcaggaccagagaattcgaatacatacgttccnnntgcatcaggt

SEQ ID NO: 204 - DNA, 46 bp, Artificial Sequence
  Synthesized adaptor oligonucleotide
  misc_feature (34)..(36): n is a, c, g, or t
tgcaggaccagagaattcgaatacacggccgcgnnntgcatcaggt

SEQ ID NO: 205 - DNA, 46 bp, Artificial Sequence
  Synthesized adaptor oligonucleotide
  misc_feature (34)..(36): n is a, c, g, or t
tgcaggaccagagaattcgaatacaatctttgtnnntgcatcaggt

SEQ ID NO: 206 - DNA, 46 bp, Artificial Sequence
  Synthesized adaptor oligonucleotide
  misc_feature (34)..(36): n is a, c, g, or t
tgcaggaccagagaattcgaatacattgtacttnnntgcatcaggt

SEQ ID NO: 207 - DNA, 46 bp, Artificial Sequence
  Synthesized adaptor oligonucleotide
  misc_feature (34)..(36): n is a, c, g, or t
tgcaggaccagagaattcgaatacatgttaatgnnntgcatcaggt

SEQ ID NO: 208 - DNA, 46 bp, Artificial Sequence
  Synthesized adaptor oligonucleotide
  misc_feature (34)..(36): n is a, c, g, or t
tgcaggaccagagaattcgaatacaaacattgtnnntgcatcaggt

SEQ ID NO: 209 - DNA, 46 bp, Artificial Sequence
  Synthesized adaptor oligonucleotide
  misc_feature (34)..(36): n is a, c, g, or t
tgcaggaccagagaattcgaatacacgcccgaannntgcatcaggt

SEQ ID NO: 210 - DNA, 46 bp, Artificial Sequence
  Synthesized adaptor oligonucleotide
  misc_feature (34)..(36): n is a, c, g, or t
tgcaggaccagagaattcgaatacacagcgcacnnntgcatcaggt

SEQ ID NO: 211 - DNA, 46 bp, Artificial Sequence
  Synthesized adaptor oligonucleotide
  misc_feature (34)..(36): n is a, c, g, or t
tgcaggaccagagaattcgaatacacgagtatcnnntgcatcaggt

SEQ ID NO: 212 - DNA, 46 bp, Artificial Sequence
  Synthesized adaptor oligonucleotide
  misc_feature (34)..(36): n is a, c, g, or t
tgcaggaccagagaattcgaatacaatggtggannntgcatcaggt

SEQ ID NO: 213 - DNA, 46 bp, Artificial Sequence
  Synthesized adaptor oligonucleotide
  misc_feature (34)..(36): n is a, c, g, or t
tgcaggaccagagaattcgaatacatcacactcnnntgcatcaggt

SEQ ID NO: 214 - DNA, 46 bp, Artificial Sequence
  Synthesized adaptor oligonucleotide
  misc_feature (34)..(36): n is a, c, g, or t
tgcaggaccagagaattcgaatacagaaacgacnnntgcatcaggt

SEQ ID NO: 215 - DNA, 46 bp, Artificial Sequence
  Synthesized adaptor oligonucleotide
  misc_feature (34)..(36): n is a, c, g, or t
tgcaggaccagagaattcgaatacagagttttannntgcatcaggt

SEQ ID NO: 216 - DNA, 46 bp, Artificial Sequence
  Synthesized adaptor oligonucleotide
  misc_feature (34)..(36): n is a, c, g, or t
tgcaggaccagagaattcgaatacaggccttttnnntgcatcaggt

SEQ ID NO: 217 - DNA, 46 bp, Artificial Sequence
  Synthesized adaptor oligonucleotide
  misc_feature (34)..(36): n is a, c, g, or t
tgcaggaccagagaattcgaatacacaactctcnnntgcatcaggt

SEQ ID NO: 218 - DNA, 46 bp, Artificial Sequence
  Synthesized adaptor oligonucleotide
  misc_feature (34)..(36): n is a, c, g, or t
tgcaggaccagagaattcgaatacatgtactggnnntgcatcaggt

SEQ ID NO: 219 - DNA, 46 bp, Artificial Sequence
  Synthesized adaptor oligonucleotide
  misc_feature (34)..(36): n is a, c, g, or t
tgcaggaccagagaattcgaatacatttggctcnnntgcatcaggt

SEQ ID NO: 220 - DNA, 46 bp, Artificial Sequence
  Synthesized adaptor oligonucleotide
  misc_feature (34)..(36): n is a, c, g, or t
tgcaggaccagagaattcgaatacagaagtatannntgcatcaggt

SEQ ID NO: 221 - DNA, 46 bp, Artificial Sequence
  Synthesized adaptor oligonucleotide
  misc_feature (34)..(36): n is a, c, g, or t
tgcaggaccagagaattcgaatacagaatcaccnnntgcatcaggt

SEQ ID NO: 222 - DNA, 46 bp, Artificial Sequence
  Synthesized adaptor oligonucleotide
  misc_feature (34)..(36): n is a, c, g, or t
tgcaggaccagagaattcgaatacacttaccgtnnntgcatcaggt

SEQ ID NO: 223 - DNA, 46 bp, Artificial Sequence
  Synthesized adaptor oligonucleotide
  misc_feature (34)..(36): n is a, c, g, or t
tgcaggaccagagaattcgaatacatctttacannntgcatcaggt

SEQ ID NO: 224 - DNA, 46 bp, Artificial Sequence
  Synthesized adaptor oligonucleotide
  misc_feature (34)..(36): n is a, c, g, or t
tgcaggaccagagaattcgaatacacgaagtgannntgcatcaggt

SEQ ID NO: 225 - DNA, 46 bp, Artificial Sequence
  Synthesized adaptor oligonucleotide
  misc_feature (34)..(36): n is a, c, g, or t
tgcaggaccagagaattcgaatacacttgtggannntgcatcaggt

SEQ ID NO: 226 - DNA, 46 bp, Artificial Sequence
  Synthesized adaptor oligonucleotide
  misc_feature (34)..(36): n is a, c, g, or t
tgcaggaccagagaattcgaatacagttctctgnnntgcatcaggt

SEQ ID NO: 227 - DNA, 46 bp, Artificial Sequence
  Synthesized adaptor oligonucleotide
  misc_feature (34)..(36): n is a, c, g, or t
tgcaggaccagagaattcgaatacaccttcaacnnntgcatcaggt

SEQ ID NO: 228 - DNA, 46 bp, Artificial Sequence
  Synthesized adaptor oligonucleotide
  misc_feature (34)..(36): n is a, c, g, or t
tgcaggaccagagaattcgaatacaaaatgcttnnntgcatcaggt

SEQ ID NO: 229 - DNA, 46 bp, Artificial Sequence
  Synthesized adaptor oligonucleotide
  misc_feature (34)..(36): n is a, c, g, or t
tgcaggaccagagaattcgaatacaatcgcgatnnntgcatcaggt

SEQ ID NO: 230 - DNA, 46 bp, Artificial Sequence
  Synthesized adaptor oligonucleotide
  misc_feature (34)..(36): n is a, c, g, or t
tgcaggaccagagaattcgaatacaggctcgtgnnntgcatcaggt

SEQ ID NO: 231 - DNA, 46 bp, Artificial Sequence
  Synthesized adaptor oligonucleotide
  misc_feature (34)..(36): n is a, c, g, or t
tgcaggaccagagaattcgaatacagaccctaannntgcatcaggt

SEQ ID NO: 232 - DNA, 46 bp, Artificial Sequence
  Synthesized adaptor oligonucleotide
  misc_feature (34)..(36): n is a, c, g, or t
tgcaggaccagagaattcgaatacacaaatttgnnntgcatcaggt

SEQ ID NO: 233 - DNA, 46 bp, Artificial Sequence
  Synthesized adaptor oligonucleotide
  misc_feature (34)..(36): n is a, c, g, or t
tgcaggaccagagaattcgaatacattttttccnnntgcatcaggt

SEQ ID NO: 234 - DNA, 46 bp, Artificial Sequence
  Synthesized adaptor oligonucleotide
  misc_feature (34)..(36): n is a, c, g, or t
tgcaggaccagagaattcgaatacatttaacgannntgcatcaggt

SEQ ID NO: 235 - DNA, 46 bp, Artificial Sequence
  Synthesized adaptor oligonucleotide
  misc_feature (34)..(36): n is a, c, g, or t
tgcaggaccagagaattcgaatacagtggtctannntgcatcaggt

SEQ ID NO: 236 - DNA, 46 bp, Artificial Sequence
  Synthesized adaptor oligonucleotide
  misc_feature (34)..(36): n is a, c, g, or t
tgcaggaccagagaattcgaatacattctaatcnnntgcatcaggt

SEQ ID NO: 237 - DNA, 46 bp, Artificial Sequence
  Synthesized adaptor oligonucleotide
  misc_feature (34)..(36): n is a, c, g, or t
tgcaggaccagagaattcgaatacaattgattgnnntgcatcaggt

SEQ ID NO: 238 - DNA, 46 bp, Artificial Sequence
  Synthesized adaptor oligonucleotide
  misc_feature (34)..(36): n is a, c, g, or t
tgcaggaccagagaattcgaatacatgcatagcnnntgcatcaggt

SEQ ID NO: 239 - DNA, 46 bp, Artificial Sequence
  Synthesized adaptor oligonucleotide
  misc_feature (34)..(36): n is a, c, g, or t
tgcaggaccagagaattcgaatacagacagatgnnntgcatcaggt

SEQ ID NO: 240 - DNA, 46 bp, Artificial Sequence
  Synthesized adaptor oligonucleotide
  misc_feature (34)..(36): n is a, c, g, or t
tgcaggaccagagaattcgaatacatgctctacnnntgcatcaggt

SEQ ID NO: 241 - DNA, 46 bp, Artificial Sequence
  Synthesized adaptor oligonucleotide
  misc_feature (34)..(36): n is a, c, g, or t
tgcaggaccagagaattcgaatacatgcgatacnnntgcatcaggt

SEQ ID NO: 242 - DNA, 46 bp, Artificial Sequence
  Synthesized adaptor oligonucleotide
  misc_feature (34)..(36): n is a, c, g, or t
tgcaggaccagagaattcgaatacaacactgcannntgcatcaggt

SEQ ID NO: 243 - DNA, 46 bp, Artificial Sequence
  Synthesized adaptor oligonucleotide
  misc_feature (34)..(36): n is a, c, g, or t
tgcaggaccagagaattcgaatacagtcactctnnntgcatcaggt

SEQ ID NO: 244 - DNA, 46 bp, Artificial Sequence
  Synthesized adaptor oligonucleotide
  misc_feature (34)..(36): n is a, c, g, or t
tgcaggaccagagaattcgaatacattgtattcnnntgcatcaggt

SEQ ID NO: 245 - DNA, 46 bp, Artificial Sequence
  Synthesized adaptor oligonucleotide
  misc_feature (34)..(36): n is a, c, g, or t
tgcaggaccagagaattcgaatacaaacctagcnnntgcatcaggt

SEQ ID NO: 246 - DNA, 46 bp, Artificial Sequence
  Synthesized adaptor oligonucleotide
  misc_feature (34)..(36): n is a, c, g, or t
tgcaggaccagagaattcgaatacagccggatcnnntgcatcaggt

SEQ ID NO: 247 - DNA, 46 bp, Artificial Sequence
  Synthesized adaptor oligonucleotide
  misc_feature (34)..(36): n is a, c, g, or t
tgcaggaccagagaattcgaatacaaggatcctnnntgcatcaggt

SEQ ID NO: 248 - DNA, 46 bp, Artificial Sequence
  Synthesized adaptor oligonucleotide
  misc_feature (34)..(36): n is a, c, g, or t
tgcaggaccagagaattcgaatacatactggacnnntgcatcaggt

SEQ ID NO: 249 - DNA, 46 bp, Artificial Sequence
  Synthesized adaptor oligonucleotide
  misc_feature (34)..(36): n is a, c, g, or t
tgcaggaccagagaattcgaatacaccctgtcgnnnacgtatgcca

SEQ ID NO: 250 - DNA, 46 bp, Artificial Sequence
  Synthesized adaptor oligonucleotide
  misc_feature (34)..(36): n is a, c, g, or t
tgcaggaccagagaattcgaatacatatcaatgnnnacgtatgcca

SEQ ID NO: 251 - DNA, 46 bp, Artificial Sequence
  Synthesized adaptor oligonucleotide
  misc_feature (34)..(36): n is a, c, g, or t
tgcaggaccagagaattcgaatacactgcagatnnnacgtatgcca

SEQ ID NO: 252 - DNA, 46 bp, Artificial Sequence
  Synthesized adaptor oligonucleotide
  misc_feature (34)..(36): n is a, c, g, or t
tgcaggaccagagaattcgaatacaatcggatcnnnacgtatgcca

SEQ ID NO: 253 - DNA, 46 bp, Artificial Sequence
  Synthesized adaptor oligonucleotide
  misc_feature (34)..(36): n is a, c, g, or t
tgcaggaccagagaattcgaatacactgttccannnacgtatgcca

SEQ ID NO: 254 - DNA, 46 bp, Artificial Sequence
  Synthesized adaptor oligonucleotide
  misc_feature (34)..(36): n is a, c, g, or t
tgcaggaccagagaattcgaatacatcacatttnnnacgtatgcca

SEQ ID NO: 255 - DNA, 46 bp, Artificial Sequence
  Synthesized adaptor oligonucleotide
  misc_feature (34)..(36): n is a, c, g, or t
tgcaggaccagagaattcgaatacagcgtggctnnnacgtatgcca

SEQ ID NO: 256 - DNA, 46 bp, Artificial Sequence
  Synthesized adaptor oligonucleotide
  misc_feature (34)..(36): n is a, c, g, or t
tgcaggaccagagaattcgaatacacggagtaannnacgtatgcca

SEQ ID NO: 257 - DNA, 46 bp, Artificial Sequence
  Synthesized adaptor oligonucleotide
  misc_feature (34)..(36): n is a, c, g, or t
tgcaggaccagagaattcgaatacagtgtccggnnnacgtatgcca

SEQ ID NO: 258 - DNA, 46 bp, Artificial Sequence
  Synthesized adaptor oligonucleotide
  misc_feature (34)..(36): n is a, c, g, or t
tgcaggaccagagaattcgaatacatattgtagnnnacgtatgcca

SEQ ID NO: 259 - DNA, 46 bp, Artificial Sequence
  Synthesized adaptor oligonucleotide
  misc_feature (34)..(36): n is a, c, g, or t
tgcaggaccagagaattcgaatacatagtattgnnnacgtatgcca

SEQ ID NO: 260 - DNA, 46 bp, Artificial Sequence
  Synthesized adaptor oligonucleotide
  misc_feature (34)..(36): n is a, c, g, or t
tgcaggaccagagaattcgaatacaagcgcttannnacgtatgcca

SEQ ID NO: 261 - DNA, 46 bp, Artificial Sequence
  Synthesized adaptor oligonucleotide
  misc_feature (34)..(36): n is a, c, g, or t
tgcaggaccagagaattcgaatacatgcaggttnnnacgtatgcca

SEQ ID NO: 262 - DNA, 46 bp, Artificial Sequence
  Synthesized adaptor oligonucleotide
  misc_feature (34)..(36): n is a, c, g, or t
tgcaggaccagagaattcgaatacacctccggtnnnacgtatgcca

SEQ ID NO: 263 - DNA, 46 bp, Artificial Sequence
  Synthesized adaptor oligonucleotide
  misc_feature (34)..(36): n is a, c, g, or t
tgcaggaccagagaattcgaatacaagacggatnnnacgtatgcca

SEQ ID NO: 264 - DNA, 46 bp, Artificial Sequence
  Synthesized adaptor oligonucleotide
  misc_feature (34)..(36): n is a, c, g, or t
tgcaggaccagagaattcgaatacatctgtctgnnnacgtatgcca

SEQ ID NO: 265 - DNA, 46 bp, Artificial Sequence
  Synthesized adaptor oligonucleotide
  misc_feature (34)..(36): n is a, c, g, or t
tgcaggaccagagaattcgaatacattcaccgtnnnacgtatgcca

SEQ ID NO: 266 - DNA, 46 bp, Artificial Sequence
  Synthesized adaptor oligonucleotide
  misc_feature (34)..(36): n is a, c, g, or t
tgcaggaccagagaattcgaatacacgtaaaggnnnacgtatgcca

SEQ ID NO: 267 - DNA, 46 bp, Artificial Sequence
  Synthesized adaptor oligonucleotide
  misc_feature (34)..(36): n is a, c, g, or t
tgcaggaccagagaattcgaatacaagaaagaannnacgtatgcca

SEQ ID NO: 268 - DNA, 46 bp, Artificial Sequence
  Synthesized adaptor oligonucleotide
  misc_feature (34)..(36): n is a, c, g, or t
tgcaggaccagagaattcgaatacaagtagtttnnnacgtatgcca

SEQ ID NO: 269 - DNA, 46 bp, Artificial Sequence
  Synthesized adaptor oligonucleotide
  misc_feature (34)..(36): n is a, c, g, or t
tgcaggaccagagaattcgaatacaggtacctannnacgtatgcca

SEQ ID NO: 270 - DNA, 46 bp, Artificial Sequence
  Synthesized adaptor oligonucleotide
  misc_feature (34)..(36): n is a, c, g, or t
tgcaggaccagagaattcgaatacagaagcacannnacgtatgcca

SEQ ID NO: 271 - DNA, 46 bp, Artificial Sequence
  Synthesized adaptor oligonucleotide
  misc_feature (34)..(36): n is a, c, g, or t
tgcaggaccagagaattcgaatacactaataacnnnacgtatgcca

SEQ ID NO: 272 - DNA, 46 bp, Artificial Sequence
  Synthesized adaptor oligonucleotide
  misc_feature (34)..(36): n is a, c, g, or t
tgcaggaccagagaattcgaatacaacggacaannnacgtatgcca

SEQ ID NO: 273 - DNA, 46 bp, Artificial Sequence
  Synthesized adaptor oligonucleotide
  misc_feature (34)..(36): n is a, c, g, or t
tgcaggaccagagaattcgaatacaatccagtgnnnacgtatgcca

SEQ ID NO: 274 - DNA, 46 bp, Artificial Sequence
  Synthesized adaptor oligonucleotide
  misc_feature (34)..(36): n is a, c, g, or t
tgcaggaccagagaattcgaatacaggacaacannnacgtatgcca

SEQ ID NO: 275 - DNA, 46 bp, Artificial Sequence
  Synthesized adaptor oligonucleotide
  misc_feature (34)..(36): n is a, c, g, or t
tgcaggaccagagaattcgaatacagaaagttannnacgtatgcca

SEQ ID NO: 276 - DNA, 46 bp, Artificial Sequence
  Synthesized adaptor oligonucleotide
  misc_feature (34)..(36): n is a, c, g, or t
tgcaggaccagagaattcgaatacaaacacaggnnnacgtatgcca

SEQ ID NO: 277 - DNA, 46 bp, Artificial Sequence
  Synthesized adaptor oligonucleotide
  misc_feature (34)..(36): n is a, c, g, or t
tgcaggaccagagaattcgaatacaccagaatcnnnacgtatgcca

SEQ ID NO: 278 - DNA, 46 bp, Artificial Sequence
  Synthesized adaptor oligonucleotide
  misc_feature (34)..(36): n is a, c, g, or t
tgcaggaccagagaattcgaatacattcaccacnnnacgtatgcca

SEQ ID NO: 279 - DNA, 46 bp, Artificial Sequence
  Synthesized adaptor oligonucleotide
  misc_feature (34)..(36): n is a, c, g, or t
tgcaggaccagagaattcgaatacatcgagagannnacgtatgcca

SEQ ID NO: 280 - DNA, 46 bp, Artificial Sequence
  Synthesized adaptor oligonucleotide
  misc_feature (34)..(36): n is a, c, g, or t
tgcaggaccagagaattcgaatacacgatgtcannnacgtatgcca

SEQ ID NO: 281 - DNA, 46 bp, Artificial Sequence
  Synthesized adaptor oligonucleotide
  misc_feature (34)..(36): n is a, c, g, or t
tgcaggaccagagaattcgaatacacggcaggannnacgtatgcca

SEQ ID NO: 282 - DNA, 46 bp, Artificial Sequence
  Synthesized adaptor oligonucleotide
  misc_feature (34)..(36): n is a, c, g, or t
tgcaggaccagagaattcgaatacaagaaccagnnnacgtatgcca

SEQ ID NO: 283 - DNA, 46 bp, Artificial Sequence
  Synthesized adaptor oligonucleotide
  misc_feature (34)..(36): n is a, c, g, or t
tgcaggaccagagaattcgaatacagattttgannnacgtatgcca

SEQ ID NO: 284 - DNA, 46 bp, Artificial Sequence
  Synthesized adaptor oligonucleotide
  misc_feature (34)..(36): n is a, c, g, or t
tgcaggaccagagaattcgaatacaaacacgtcnnnacgtatgcca

SEQ ID NO: 285 - DNA, 46 bp, Artificial Sequence
  Synthesized adaptor oligonucleotide
  misc_feature (34)..(36): n is a, c, g, or t
tgcaggaccagagaattcgaatacaacctctacnnnacgtatgcca

SEQ ID NO: 286 - DNA, 46 bp, Artificial Sequence
  Synthesized adaptor oligonucleotide
  misc_feature (34)..(36): n is a, c, g, or t
tgcaggaccagagaattcgaatacaggcgtttannnacgtatgcca

SEQ ID NO: 287 - DNA, 46 bp, Artificial Sequence
  Synthesized adaptor oligonucleotide
  misc_feature (34)..(36): n is a, c, g, or t
tgcaggaccagagaattcgaatacacccgaagcnnnacgtatgcca

SEQ ID NO: 288 - DNA, 46 bp, Artificial Sequence
  Synthesized adaptor oligonucleotide
  misc_feature (34)..(36): n is a, c, g, or t
tgcaggaccagagaattcgaatacatacctaccnnnacgtatgcca

SEQ ID NO: 289 - DNA, 46 bp, Artificial Sequence
  Synthesized adaptor oligonucleotide
  misc_feature (34)..(36): n is a, c, g, or t
tgcaggaccagagaattcgaatacatttacgccnnnacgtatgcca

SEQ ID NO: 290 - DNA, 46 bp, Artificial Sequence
  Synthesized adaptor oligonucleotide
  misc_feature (34)..(36): n is a, c, g, or t
tgcaggaccagagaattcgaatacaaggtatggnnnacgtatgcca

SEQ ID NO: 291 - DNA, 46 bp, Artificial Sequence
  Synthesized adaptor oligonucleotide
  misc_feature (34)..(36): n is a, c, g, or t
tgcaggaccagagaattcgaatacaactacaatnnnacgtatgcca

SEQ ID NO: 292 - DNA, 46 bp, Artificial Sequence
  Synthesized adaptor oligonucleotide
  misc_feature (34)..(36): n is a, c, g, or t
tgcaggaccagagaattcgaatacactcctcaannnacgtatgcca

SEQ ID NO: 293 - DNA, 46 bp, Artificial Sequence
  Synthesized adaptor oligonucleotide
  misc_feature (34)..(36): n is a, c, g, or t
tgcaggaccagagaattcgaatacagatacaaannnacgtatgcca

SEQ ID NO: 294 - DNA, 46 bp, Artificial Sequence
  Synthesized adaptor oligonucleotide
  misc_feature (34)..(36): n is a, c, g, or t
tgcaggaccagagaattcgaatacaccaacacannnacgtatgcca

SEQ ID NO: 295 - DNA, 46 bp, Artificial Sequence
  Synthesized adaptor oligonucleotide
  misc_feature (34)..(36): n is a, c, g, or t
tgcaggaccagagaattcgaatacaacccattcnnnacgtatgcca

SEQ ID NO: 296 - DNA, 46 bp, Artificial Sequence
  Synthesized adaptor oligonucleotide
  misc_feature (34)..(36): n is a, c, g, or t
tgcaggaccagagaattcgaatacatctaagcgnnnacgtatgcca

SEQ ID NO: 297 - DNA, 46 bp, Artificial Sequence
  Synthesized adaptor oligonucleotide
  misc_feature (34)..(36): n is a, c, g, or t
tgcaggaccagagaattcgaatacacttaaggcnnnacgtatgcca

SEQ ID NO: 298 - DNA, 46 bp, Artificial Sequence
  Synthesized adaptor oligonucleotide
  misc_feature (34)..(36): n is a, c, g, or t
tgcaggaccagagaattcgaatacacgaatccannnacgtatgcca

SEQ ID NO: 299 - DNA, 46 bp, Artificial Sequence
  Synthesized adaptor oligonucleotide
  misc_feature (34)..(36): n is a, c, g, or t
tgcaggaccagagaattcgaatacacaactaatnnnacgtatgcca

SEQ ID NO: 300 - DNA, 46 bp, Artificial Sequence
  Synthesized adaptor oligonucleotide
  misc_feature (34)..(36): n is a, c, g, or t
tgcaggaccagagaattcgaatacatcacacctnnnacgtatgcca

SEQ ID NO: 301 - DNA, 46 bp, Artificial Sequence
  Synthesized adaptor oligonucleotide
  misc_feature (34)..(36): n is a, c, g, or t
tgcaggaccagagaattcgaatacagaccgtcgnnnacgtatgcca

SEQ ID NO: 302 - DNA, 46 bp, Artificial Sequence
  Synthesized adaptor oligonucleotide
  misc_feature (34)..(36): n is a, c, g, or t
tgcaggaccagagaattcgaatacactttaagannnacgtatgcca

SEQ ID NO: 303 - DNA, 46 bp, Artificial Sequence
  Synthesized adaptor oligonucleotide
  misc_feature (34)..(36): n is a, c, g, or t
tgcaggaccagagaattcgaatacatgtgattannnacgtatgcca

SEQ ID NO: 304 - DNA, 46 bp, Artificial Sequence
  Synthesized adaptor oligonucleotide
  misc_feature (34)..(36): n is a, c, g, or t
tgcaggaccagagaattcgaatacaacccaatgnnnacgtatgcca

SEQ ID NO: 305 - DNA, 46 bp, Artificial Sequence
  Synthesized adaptor oligonucleotide
  misc_feature (34)..(36): n is a, c, g, or t
tgcaggaccagagaattcgaatacaacgtgtacnnnacgtatgcca

SEQ ID NO: 306 - DNA, 46 bp, Artificial Sequence
  Synthesized adaptor oligonucleotide
  misc_feature (34)..(36): n is a, c, g, or t
tgcaggaccagagaattcgaatacaatgaaatgnnnacgtatgcca

SEQ ID NO: 307 - DNA, 46 bp, Artificial Sequence
  Synthesized adaptor oligonucleotide
  misc_feature (34)..(36): n is a, c, g, or t
tgcaggaccagagaattcgaatacatcctcgtannnacgtatgcca

SEQ ID NO: 308 - DNA, 46 bp, Artificial Sequence
  Synthesized adaptor oligonucleotide
  misc_feature (34)..(36): n is a, c, g, or t
tgcaggaccagagaattcgaatacagtaacaggnnnacgtatgcca

SEQ ID NO: 309 - DNA, 46 bp, Artificial Sequence
  Synthesized adaptor oligonucleotide
  misc_feature (34)..(36): n is a, c, g, or t
tgcaggaccagagaattcgaatacaactcggtannnctagcgttac

SEQ ID NO: 310 - DNA, 46 bp, Artificial Sequence
  Synthesized adaptor oligonucleotide
  misc_feature (34)..(36): n is a, c, g, or t
tgcaggaccagagaattcgaatacaacgcttagnnnctagcgttac

SEQ ID NO: 311 - DNA, 46 bp, Artificial Sequence
  Synthesized adaptor oligonucleotide
  misc_feature (34)..(36): n is a, c, g, or t
tgcaggaccagagaattcgaatacatcaagctgnnnctagcgttac

SEQ ID NO: 312 - DNA, 46 bp, Artificial Sequence
  Synthesized adaptor oligonucleotide
  misc_feature (34)..(36): n is a, c, g, or t
tgcaggaccagagaattcgaatacatagctaatnnnctagcgttac

SEQ ID NO: 313 - DNA, 46 bp, Artificial Sequence
  Synthesized adaptor oligonucleotide
  misc_feature (34)..(36): n is a, c, g, or t
tgcaggaccagagaattcgaatacacggcattannnctagcgttac

SEQ ID NO: 314 - DNA, 46 bp, Artificial Sequence
  Synthesized adaptor oligonucleotide
  misc_feature (34)..(36): n is a, c, g, or t
tgcaggaccagagaattcgaatacaaatgatgannnctagcgttac

SEQ ID NO: 315 - DNA, 46 bp, Artificial Sequence
  Synthesized adaptor oligonucleotide
  misc_feature (34)..(36): n is a, c, g, or t
tgcaggaccagagaattcgaatacatcgcgatannnctagcgttac

SEQ ID NO: 316 - DNA, 46 bp, Artificial Sequence
  Synthesized adaptor oligonucleotide
  misc_feature (34)..(36): n is a, c, g, or t
tgcaggaccagagaattcgaatacacacaggttnnnctagcgttac

SEQ ID NO: 317 - DNA, 46 bp, Artificial Sequence
  Synthesized adaptor oligonucleotide
  misc_feature (34)..(36): n is a, c, g, or t
tgcaggaccagagaattcgaatacaacggtgccnnnctagcgttac

SEQ ID NO: 318 - DNA, 46 bp, Artificial Sequence
  Synthesized adaptor oligonucleotide
  misc_feature (34)..(36): n is a, c, g, or t
tgcaggaccagagaattcgaatacagttacagcnnnctagcgttac

SEQ ID NO: 319 - DNA, 46 bp, Artificial Sequence
  Synthesized adaptor oligonucleotide
  misc_feature (34)..(36): n is a, c, g, or t
tgcaggaccagagaattcgaatacatgcgatgtnnnctagcgttac

SEQ ID NO: 320 - DNA, 46 bp, Artificial Sequence
  Synthesized adaptor oligonucleotide
  misc_feature (34)..(36): n is a, c, g, or t
tgcaggaccagagaattcgaatacaatggtgctnnnctagcgttac

SEQ ID NO: 321 - DNA, 46 bp, Artificial Sequence
  Synthesized adaptor oligonucleotide
  misc_feature (34)..(36): n is a, c, g, or t
tgcaggaccagagaattcgaatacaaccccaggnnnctagcgttac

SEQ ID NO: 322 - DNA, 46 bp, Artificial Sequence
  Synthesized adaptor oligonucleotide
  misc_feature (34)..(36): n is a, c, g, or t
tgcaggaccagagaattcgaatacagcagacggnnnctagcgttac

SEQ ID NO: 323 - DNA, 46 bp, Artificial Sequence
  Synthesized adaptor oligonucleotide
  misc_feature (34)..(36): n is a, c, g, or t
tgcaggaccagagaattcgaatacactggcagcnnnctagcgttac

SEQ ID NO: 324 - DNA, 46 bp, Artificial Sequence
  Synthesized adaptor oligonucleotide
  misc_feature (34)..(36): n is a, c, g, or t
tgcaggaccagagaattcgaatacaagagagtcnnnctagcgttac

SEQ ID NO: 325 - DNA, 46 bp, Artificial Sequence
  Synthesized adaptor oligonucleotide
  misc_feature (34)..(36): n is a, c, g, or t
tgcaggaccagagaattcgaatacacgttttatnnnctagcgttac

SEQ ID NO: 326 - DNA, 46 bp, Artificial Sequence
  Synthesized adaptor oligonucleotide
  misc_feature (34)..(36): n is a, c, g, or t
tgcaggaccagagaattcgaatacaagaggtcannnctagcgttac

SEQ ID NO: 327 - DNA, 46 bp, Artificial Sequence
  Synthesized adaptor oligonucleotide
  misc_feature (34)..(36): n is a, c, g, or t
tgcaggaccagagaattcgaatacattctctccnnnctagcgttac

SEQ ID NO: 328 - DNA, 46 bp, Artificial Sequence
  Synthesized adaptor oligonucleotide
  misc_feature (34)..(36): n is a, c, g, or t
tgcaggaccagagaattcgaatacacgtgtcttnnnctagcgttac

SEQ ID NO: 329 - DNA, 46 bp, Artificial Sequence
  Synthesized adaptor oligonucleotide
  misc_feature (34)..(36): n is a, c, g, or t
tgcaggaccagagaattcgaatacactcagcaannnctagcgttac

SEQ ID NO: 330 - DNA, 46 bp, Artificial Sequence
  Synthesized adaptor oligonucleotide
  misc_feature (34)..(36): n is a, c, g, or t
tgcaggaccagagaattcgaatacatcttatgtnnnctagcgttac

SEQ ID NO: 331 - DNA, 46 bp, Artificial Sequence
  Synthesized adaptor oligonucleotide
  misc_feature (34)..(36): n is a, c, g, or t
tgcaggaccagagaattcgaatacatcggcacgnnnctagcgttac

SEQ ID NO: 332 - DNA, 46 bp, Artificial Sequence
  Synthesized adaptor oligonucleotide
  misc_feature (34)..(36): n is a, c, g, or t
tgcaggaccagagaattcgaatacacgtttctgnnnctagcgttac

SEQ ID NO: 333 - DNA, 46 bp, Artificial Sequence
  Synthesized adaptor oligonucleotide
  misc_feature (34)..(36): n is a, c, g, or t
tgcaggaccagagaattcgaatacaatgtgaggnnnctagcgttac

SEQ ID NO: 334 - DNA, 46 bp, Artificial Sequence
  Synthesized adaptor oligonucleotide
  misc_feature (34)..(36): n is a, c, g, or t
tgcaggaccagagaattcgaatacaagaaacatnnnctagcgttac

SEQ ID NO: 335 - DNA, 46 bp, Artificial Sequence
  Synthesized adaptor oligonucleotide
  misc_feature (34)..(36): n is a, c, g, or t
tgcaggaccagagaattcgaatacagagagaagnnnctagcgttac

SEQ ID NO: 336 - DNA, 46 bp, Artificial Sequence
  Synthesized adaptor oligonucleotide
  misc_feature (34)..(36): n is a, c, g, or t
tgcaggaccagagaattcgaatacacttcaggannnctagcgttac

SEQ ID NO: 337 - DNA, 46 bp, Artificial Sequence
  Synthesized adaptor oligonucleotide
  misc_feature (34)..(36): n is a, c, g, or t
tgcaggaccagagaattcgaatacatccctcggnnnctagcgttac

SEQ ID NO: 338 - DNA, 46 bp, Artificial Sequence
  Synthesized adaptor oligonucleotide
  misc_feature (34)..(36): n is a, c, g, or t
tgcaggaccagagaattcgaatacaccttccttnnnctagcgttac

SEQ ID NO: 339 - DNA, 46 bp, Artificial Sequence
  Synthesized adaptor oligonucleotide
  misc_feature (34)..(36): n is a, c, g, or t
tgcaggaccagagaattcgaatacatagttatgnnnctagcgttac

SEQ ID NO: 340 - DNA, 46 bp, Artificial Sequence
  Synthesized adaptor oligonucleotide
  misc_feature (34)..(36): n is a, c, g, or t
tgcaggaccagagaattcgaatacagcatagagnnnctagcgttac

SEQ ID NO: 341 - DNA, 46 bp, Artificial Sequence
  Synthesized adaptor oligonucleotide
  misc_feature (34)..(36): n is a, c, g, or t
tgcaggaccagagaattcgaatacatagctcctnnnctagcgttac

SEQ ID NO: 342 - DNA, 46 bp, Artificial Sequence
  Synthesized adaptor oligonucleotide
  misc_feature (34)..(36): n is a, c, g, or t
tgcaggaccagagaattcgaatacaaccacgtannnctagcgttac

SEQ ID NO: 343 - DNA, 46 bp, Artificial Sequence
  Synthesized adaptor oligonucleotide
  misc_feature (34)..(36): n is a, c, g, or t
tgcaggaccagagaattcgaatacacatcgtctnnnctagcgttac

SEQ ID NO: 344 - DNA, 46 bp, Artificial Sequence
  Synthesized adaptor oligonucleotide
  misc_feature (34)..(36): n is a, c, g, or t
tgcaggaccagagaattcgaatacaagagattannnctagcgttac

SEQ ID NO: 345 - DNA, 46 bp, Artificial Sequence
  Synthesized adaptor oligonucleotide
  misc_feature (34)..(36): n is a, c, g, or t
tgcaggaccagagaattcgaatacaatcaaagannnctagcgttac

SEQ ID NO: 346 - DNA, 46 bp, Artificial Sequence
  Synthesized adaptor oligonucleotide
  misc_feature (34)..(36): n is a, c, g, or t
tgcaggaccagagaattcgaatacaggagtacannnctagcgttac

SEQ ID NO: 347 - DNA, 46 bp, Artificial Sequence
  Synthesized adaptor oligonucleotide
  misc_feature (34)..(36): n is a, c, g, or t
tgcaggaccagagaattcgaatacaatagcaggnnnctagcgttac

SEQ ID NO: 348 - DNA, 46 bp, Artificial Sequence
  Synthesized adaptor oligonucleotide
  misc_feature (34)..(36): n is a, c, g, or t
tgcaggaccagagaattcgaatacatctaattcnnnctagcgttac

SEQ ID NO: 349 - DNA, 46 bp, Artificial Sequence
  Synthesized adaptor oligonucleotide
  misc_feature (34)..(36): n is a, c, g, or t
tgcaggaccagagaattcgaatacagttcccgcnnnctagcgttac

SEQ ID NO: 350 - DNA, 46 bp, Artificial Sequence
  Synthesized adaptor oligonucleotide
  misc_feature (34)..(36): n is a, c, g, or t
tgcaggaccagagaattcgaatacatagatttgnnnctagcgttac

SEQ ID NO: 351 - DNA, 46 bp, Artificial Sequence
  Synthesized adaptor oligonucleotide
  misc_feature (34)..(36): n is a, c, g, or t
tgcaggaccagagaattcgaatacacggcagagnnnctagcgttac

SEQ ID NO: 352 - DNA, 46 bp, Artificial Sequence
  Synthesized adaptor oligonucleotide
  misc_feature (34)..(36): n is a, c, g, or t
tgcaggaccagagaattcgaatacacctcgtgcnnnctagcgttac

SEQ ID NO: 353 - DNA, 46 bp, Artificial Sequence
  Synthesized adaptor oligonucleotide
  misc_feature (34)..(36): n is a, c, g, or t
tgcaggaccagagaattcgaatacacccttgatnnnctagcgttac

SEQ ID NO: 354 - DNA, 46 bp, Artificial Sequence
  Synthesized adaptor oligonucleotide
  misc_feature (34)..(36): n is a, c, g, or t
tgcaggaccagagaattcgaatacacgtcacggnnnctagcgttac

SEQ ID NO: 355 - DNA, 46 bp, Artificial Sequence
  Synthesized adaptor oligonucleotide
  misc_feature (34)..(36): n is a, c, g, or t
tgcaggaccagagaattcgaatacagtttggcannnctagcgttac

SEQ ID NO: 356 - DNA, 46 bp, Artificial Sequence
  Synthesized adaptor oligonucleotide
  misc_feature (34)..(36): n is a, c, g, or t
tgcaggaccagagaattcgaatacatgctctgtnnnctagcgttac

SEQ ID NO: 357 - DNA, 46 bp, Artificial Sequence
  Synthesized adaptor oligonucleotide
  misc_feature (34)..(36): n is a, c, g, or t
tgcaggaccagagaattcgaatacatcagtatannnctagcgttac

SEQ ID NO: 358 - DNA, 46 bp, Artificial Sequence
  Synthesized adaptor oligonucleotide
  misc_feature (34)..(36): n is a, c, g, or t
tgcaggaccagagaattcgaatacacccaagtannnctagcgttac

SEQ ID NO: 359 - DNA, 46 bp, Artificial Sequence
  Synthesized adaptor oligonucleotide
  misc_feature (34)..(36): n is a, c, g, or t
tgcaggaccagagaattcgaatacaaagctaaannnctagcgttac

SEQ ID NO: 360 - DNA, 46 bp, Artificial Sequence
  Synthesized adaptor oligonucleotide
  misc_feature (34)..(36): n is a, c, g, or t
tgcaggaccagagaattcgaatacaagatccacnnnctagcgttac

SEQ ID NO: 361 - DNA, 46 bp, Artificial Sequence
  Synthesized adaptor oligonucleotide
  misc_feature (34)..(36): n is a, c, g, or t
tgcaggaccagagaattcgaatacagcatcggcnnnctagcgttac

SEQ ID NO: 362 - DNA, 46 bp, Artificial Sequence
  Synthesized adaptor oligonucleotide
  misc_feature (34)..(36): n is a, c, g, or t
tgcaggaccagagaattcgaatacactctggaannnctagcgttac

SEQ ID NO: 363 - DNA, 46 bp, Artificial Sequence
  Synthesized adaptor oligonucleotide
  misc_feature (34)..(36): n is a, c, g, or t
tgcaggaccagagaattcgaatacaagtctgacnnnctagcgttac

SEQ ID NO: 364 - DNA, 46 bp, Artificial Sequence
  Synthesized adaptor oligonucleotide
  misc_feature (34)..(36): n is a, c, g, or t
tgcaggaccagagaattcgaatacagaggccgannnctagcgttac

SEQ ID NO: 365 - DNA, 46 bp, Artificial Sequence
  Synthesized adaptor oligonucleotide
  misc_feature (34)..(36): n is a, c, g, or t
tgcaggaccagagaattcgaatacatggtggaannnctagcgttac

SEQ ID NO: 366 - DNA, 46 bp, Artificial Sequence
  Synthesized adaptor oligonucleotide
  misc_feature (34)..(36): n is a, c, g, or t
tgcaggaccagagaattcgaatacacggtgttannnctagcgttac

SEQ ID NO: 367 - DNA, 46 bp, Artificial Sequence
  Synthesized adaptor oligonucleotide
  misc_feature (34)..(36): n is a, c, g, or t
tgcaggaccagagaattcgaatacatcgcgcagnnnctagcgttac

SEQ ID NO: 368 - DNA, 46 bp, Artificial Sequence
  Synthesized adaptor oligonucleotide
  misc_feature (34)..(36): n is a, c, g, or t
tgcaggaccagagaattcgaatacagctgtgtannnctagcgttac

SEQ ID NO: 369 - DNA, 46 bp, Artificial Sequence
  Synthesized adaptor oligonucleotide
  misc_feature (34)..(36): n is a, c, g, or t
tgcaggaccagagaattcgaatacaacgtgcgcnnngatcgacatg

SEQ ID NO: 370 - DNA, 46 bp, Artificial Sequence
  Synthesized adaptor oligonucleotide
  misc_feature (34)..(36): n is a, c, g, or t
tgcaggaccagagaattcgaatacaatcagccannngatcgacatg

SEQ ID NO: 371 - DNA, 46 bp, Artificial Sequence
  Synthesized adaptor oligonucleotide
  misc_feature (34)..(36): n is a, c, g, or t
tgcaggaccagagaattcgaatacagatacttannngatcgacatg

SEQ ID NO: 372 - DNA, 46 bp, Artificial Sequence
  Synthesized adaptor oligonucleotide
  misc_feature (34)..(36): n is a, c, g, or t
tgcaggaccagagaattcgaatacaatttcgccnnngatcgacatg

SEQ ID NO: 373 - DNA, 46 bp, Artificial Sequence
  Synthesized adaptor oligonucleotide
  misc_feature (34)..(36): n is a, c, g, or t
tgcaggaccagagaattcgaatacacttaaagtnnngatcgacatg

SEQ ID NO: 374 - DNA, 46 bp, Artificial Sequence
  Synthesized adaptor oligonucleotide
  misc_feature (34)..(36): n is a, c, g, or t
tgcaggaccagagaattcgaatacatatgccctnnngatcgacatg

SEQ ID NO: 375 - DNA, 46 bp, Artificial Sequence
  Synthesized adaptor oligonucleotide
  misc_feature (34)..(36): n is a, c, g, or t
tgcaggaccagagaattcgaatacaacttgacgnnngatcgacatg

SEQ ID NO: 376 - DNA, 46 bp, Artificial Sequence
  Synthesized adaptor oligonucleotide
  misc_feature (34)..(36): n is a, c, g, or t
tgcaggaccagagaattcgaatacaaggaaccannngatcgacatg

SEQ ID NO: 377 - DNA, 46 bp, Artificial Sequence
  Synthesized adaptor oligonucleotide
  misc_feature (34)..(36): n is a, c, g, or t
tgcaggaccagagaattcgaatacatgagcgaannngatcgacatg

SEQ ID NO: 378 - DNA, 46 bp, Artificial Sequence
  Synthesized adaptor oligonucleotide
  misc_feature (34)..(36): n is a, c, g, or t
tgcaggaccagagaattcgaatacatgctgtgannngatcgacatg

SEQ ID NO: 379 - DNA, 46 bp, Artificial Sequence
  Synthesized adaptor oligonucleotide
  misc_feature (34)..(36): n is a, c, g, or t
tgcaggaccagagaattcgaatacaggttcgtannngatcgacatg

SEQ ID NO: 380 - DNA, 46 bp, Artificial Sequence
  Synthesized adaptor oligonucleotide
  misc_feature (34)..(36): n is a, c, g, or t
tgcaggaccagagaattcgaatacaacaaacaannngatcgacatg

SEQ ID NO: 381 - DNA, 46 bp, Artificial Sequence
  Synthesized adaptor oligonucleotide
  misc_feature (34)..(36): n is a, c, g, or t
tgcaggaccagagaattcgaatacaagctagagnnngatcgacatg

SEQ ID NO: 382 - DNA, 46 bp, Artificial Sequence
  Synthesized adaptor oligonucleotide
  misc_feature (34)..(36): n is a, c, g, or t
tgcaggaccagagaattcgaatacattaaatatnnngatcgacatg

SEQ ID NO: 383 - DNA, 46 bp, Artificial Sequence
  Synthesized adaptor oligonucleotide
  misc_feature (34)..(36): n is a, c, g, or t
tgcaggaccagagaattcgaatacaaggagtcannngatcgacatg

SEQ ID NO: 384 - DNA, 46 bp, Artificial Sequence
  Synthesized adaptor oligonucleotide
  misc_feature (34)..(36): n is a, c, g, or t
tgcaggaccagagaattcgaatacacgcacagcnnngatcgacatg

SEQ ID NO: 385 - DNA, 46 bp, Artificial Sequence
  Synthesized adaptor oligonucleotide
  misc_feature (34)..(36): n is a, c, g, or t
tgcaggaccagagaattcgaatacagcggacagnnngatcgacatg

SEQ ID NO: 386 - DNA, 46 bp, Artificial Sequence
  Synthesized adaptor oligonucleotide
  misc_feature (34)..(36): n is a, c, g, or t
tgcaggaccagagaattcgaatacacgctcgtcnnngatcgacatg

SEQ ID NO: 387 - DNA, 46 bp, Artificial Sequence
  Synthesized adaptor oligonucleotide
  misc_feature (34)..(36): n is a, c, g, or t
tgcaggaccagagaattcgaatacatctgatggnnngatcgacatg

SEQ ID NO: 388 - DNA, 46 bp, Artificial Sequence
  Synthesized adaptor oligonucleotide
  misc_feature (34)..(36): n is a, c, g, or t
tgcaggaccagagaattcgaatacaggctagaannngatcgacatg

SEQ ID NO: 389 - DNA, 46 bp, Artificial Sequence
  Synthesized adaptor oligonucleotide
  misc_feature (34)..(36): n is a, c, g, or t
tgcaggaccagagaattcgaatacaatgaggcannngatcgacatg

SEQ ID NO: 390 - DNA, 46 bp, Artificial Sequence
  Synthesized adaptor oligonucleotide
  misc_feature (34)..(36): n is a, c, g, or t
tgcaggaccagagaattcgaatacacacccgtcnnngatcgacatg

SEQ ID NO: 391 - DNA, 46 bp, Artificial Sequence
  Synthesized adaptor oligonucleotide
  misc_feature (34)..(36): n is a, c, g, or t
tgcaggaccagagaattcgaatacatcatcggannngatcgacatg

SEQ ID NO: 392 - DNA, 46 bp, Artificial Sequence
  Synthesized adaptor oligonucleotide
  misc_feature (34)..(36): n is a, c, g, or t
tgcaggaccagagaattcgaatacaggcaagcgnnngatcgacatg

SEQ ID NO: 393 - DNA, 46 bp, Artificial Sequence
  Synthesized adaptor oligonucleotide
  misc_feature (34)..(36): n is a, c, g, or t
tgcaggaccagagaattcgaatacacagtcgatnnngatcgacatg

SEQ ID NO: 394 - DNA, 46 bp, Artificial Sequence
  Synthesized adaptor oligonucleotide
  misc_feature (34)..(36): n is a, c, g, or t
tgcaggaccagagaattcgaatacatgctactcnnngatcgacatg

SEQ ID NO: 395 - DNA, 46 bp, Artificial Sequence
  Synthesized adaptor oligonucleotide
  misc_feature (34)..(36): n is a, c, g, or t
tgcaggaccagagaattcgaatacatccataccnnngatcgacatg

SEQ ID NO: 396 - DNA, 46 bp, Artificial Sequence
  Synthesized adaptor oligonucleotide
  misc_feature (34)..(36): n is a, c, g, or t
tgcaggaccagagaattcgaatacaaccgcgacnnngatcgacatg

SEQ ID NO: 397 - DNA, 46 bp, Artificial Sequence
  Synthesized adaptor oligonucleotide
  misc_feature (34)..(36): n is a, c, g, or t
tgcaggaccagagaattcgaatacaggcaaagtnnngatcgacatg

SEQ ID NO: 398 - DNA, 46 bp, Artificial Sequence
  Synthesized adaptor oligonucleotide
  misc_feature (34)..(36): n is a, c, g, or t
tgcaggaccagagaattcgaatacaggatcccgnnngatcgacatg

SEQ ID NO: 399 - DNA, 46 bp, Artificial Sequence
  Synthesized adaptor oligonucleotide
  misc_feature (34)..(36): n is a, c, g, or t
tgcaggaccagagaattcgaatacacctctcttnnngatcgacatg

SEQ ID NO: 400 - DNA, 46 bp, Artificial Sequence
  Synthesized adaptor oligonucleotide
  misc_feature (34)..(36): n is a, c, g, or t
tgcaggaccagagaattcgaatacatcgtcgccnnngatcgacatg

SEQ ID NO: 401 - DNA, 46 bp, Artificial Sequence
  Synthesized adaptor oligonucleotide
  misc_feature (34)..(36): n is a, c, g, or t
tgcaggaccagagaattcgaatacacctatgtcnnngatcgacatg

SEQ ID NO: 402 - DNA, 46 bp, Artificial Sequence
  Synthesized adaptor oligonucleotide
  misc_feature (34)..(36): n is a, c, g, or t
tgcaggaccagagaattcgaatacaggatgcttnnngatcgacatg

SEQ ID NO: 403 - DNA, 46 bp, Artificial Sequence
  Synthesized adaptor oligonucleotide
  misc_feature (34)..(36): n is a, c, g, or t
tgcaggaccagagaattcgaatacaattgagaannngatcgacatg

SEQ ID NO: 404 - DNA, 46 bp, Artificial Sequence
  Synthesized adaptor oligonucleotide
  misc_feature (34)..(36): n is a, c, g, or t
tgcaggaccagagaattcgaatacagtgttgtgnnngatcgacatg

SEQ ID NO: 405 - DNA, 46 bp, Artificial Sequence
  Synthesized adaptor oligonucleotide
  misc_feature (34)..(36): n is a, c, g, or t
tgcaggaccagagaattcgaatacaaagcaatannngatcgacatg

SEQ ID NO: 406 - DNA, 46 bp, Artificial Sequence
  Synthesized adaptor oligonucleotide
  misc_feature (34)..(36): n is a, c, g, or t
tgcaggaccagagaattcgaatacattagcgcannngatcgacatg

SEQ ID NO: 407 - DNA, 46 bp, Artificial Sequence
  Synthesized adaptor oligonucleotide
  misc_feature (34)..(36): n is a, c, g, or t
tgcaggaccagagaattcgaatacaaacggatgnnngatcgacatg

SEQ ID NO: 408 - DNA, 46 bp, Artificial Sequence
  Synthesized adaptor oligonucleotide
  misc_feature (34)..(36): n is a, c, g, or t
tgcaggaccagagaattcgaatacagcatggaannngatcgacatg

SEQ ID NO: 409 - DNA, 46 bp, Artificial Sequence
  Synthesized adaptor oligonucleotide
  misc_feature (34)..(36): n is a, c, g, or t
tgcaggaccagagaattcgaatacatctcatatnnngatcgacatg

SEQ ID NO: 410 - DNA, 46 bp, Artificial Sequence
  Synthesized adaptor oligonucleotide
  misc_feature (34)..(36): n is a, c, g, or t
tgcaggaccagagaattcgaatacactgcgcctnnngatcgacatg

SEQ ID NO: 411 - DNA, 46 bp, Artificial Sequence
  Synthesized adaptor oligonucleotide
  misc_feature (34)..(36): n is a, c, g, or t
tgcaggaccagagaattcgaatacagattcgcannngatcgacatg

SEQ ID NO: 412 - DNA, 46 bp, Artificial Sequence
  Synthesized adaptor oligonucleotide
  misc_feature (34)..(36): n is a, c, g, or t
tgcaggaccagagaattcgaatacaatctatctnnngatcgacatg

SEQ ID NO: 413 - DNA, 46 bp, Artificial Sequence
  Synthesized adaptor oligonucleotide
  misc_feature (34)..(36): n is a, c, g, or t
tgcaggaccagagaattcgaatacagtcaccccnnngatcgacatg

SEQ ID NO: 414 - DNA, 46 bp, Artificial Sequence
  Synthesized adaptor oligonucleotide
  misc_feature (34)..(36): n is a, c, g, or t
tgcaggaccagagaattcgaatacacgttgtgannngatcgacatg

SEQ ID NO: 415 - DNA, 46 bp, Artificial Sequence
  Synthesized adaptor oligonucleotide
  misc_feature (34)..(36): n is a, c, g, or t
tgcaggaccagagaattcgaatacagctctgccnnngatcgacatg

SEQ ID NO: 416 - DNA, 46 bp, Artificial Sequence
  Synthesized adaptor oligonucleotide
  misc_feature (34)..(36): n is a, c, g, or t
tgcaggaccagagaattcgaatacacatcgatgnnngatcgacatg

SEQ ID NO: 417 - DNA, 46 bp, Artificial Sequence
  Synthesized adaptor oligonucleotide
  misc_feature (34)..(36): n is a, c, g, or t
tgcaggaccagagaattcgaatacaagtcgccgnnngatcgacatg

SEQ ID NO: 418 - DNA, 46 bp, Artificial Sequence
  Synthesized adaptor oligonucleotide
  misc_feature (34)..(36): n is a, c, g, or t
tgcaggaccagagaattcgaatacagatagcgannngatcgacatg

SEQ ID NO: 419 - DNA, 46 bp, Artificial Sequence
  Synthesized adaptor oligonucleotide
  misc_feature (34)..(36): n is a, c, g, or t
tgcaggaccagagaattcgaatacatctttggcnnngatcgacatg

SEQ ID NO: 420 - DNA, 46 bp, Artificial Sequence
  Synthesized adaptor oligonucleotide
  misc_feature (34)..(36): n is a, c, g, or t
tgcaggaccagagaattcgaatacatctcatcgnnngatcgacatg

SEQ ID NO: 421 - DNA, 46 bp, Artificial Sequence
  Synthesized adaptor oligonucleotide
  misc_feature (34)..(36): n is a, c, g, or t
tgcaggaccagagaattcgaatacatgagcgccnnngatcgacatg

SEQ ID NO: 422 - DNA, 46 bp, Artificial Sequence
  Synthesized adaptor oligonucleotide
  misc_feature (34)..(36): n is a, c, g, or t
tgcaggaccagagaattcgaatacaagtctcgannngatcgacatg

SEQ ID NO: 423 - DNA, 46 bp, Artificial Sequence
  Synthesized adaptor oligonucleotide
  misc_feature (34)..(36): n is a, c, g, or t
tgcaggaccagagaattcgaatacaaaggtatannngatcgacatg

SEQ ID NO: 424 - DNA, 46 bp, Artificial Sequence
  Synthesized adaptor oligonucleotide
  misc_feature (34)..(36): n is a, c, g, or t
tgcaggaccagagaattcgaatacaggtgtcgcnnngatcgacatg

SEQ ID NO: 425 - DNA, 46 bp, Artificial Sequence
  Synthesized adaptor oligonucleotide
  misc_feature (34)..(36): n is a, c, g, or t
tgcaggaccagagaattcgaatacatcacatccnnngatcgacatg

SEQ ID NO: 426 - DNA, 46 bp, Artificial Sequence
  Synthesized adaptor oligonucleotide
  misc_feature (34)..(36): n is a, c, g, or t
tgcaggaccagagaattcgaatacagcatacacnnngatcgacatg

SEQ ID NO: 427 - DNA, 46 bp, Artificial Sequence
  Synthesized adaptor oligonucleotide
  misc_feature (34)..(36): n is a, c, g, or t
tgcaggaccagagaattcgaatacatccaacagnnngatcgacatg

SEQ ID NO: 428 - DNA, 46 bp, Artificial Sequence
  Synthesized adaptor oligonucleotide
  misc_feature (34)..(36): n is a, c, g, or t
tgcaggaccagagaattcgaatacatctgcctannngatcgacatg

SEQ ID NO: 429 - DNA, 46 bp, Artificial Sequence
  Synthesized adaptor oligonucleotide
  misc_feature (34)..(36): n is a, c, g, or t
tgcaggaccagagaattcgaatacacacaccggnnntgcatcaggt

SEQ ID NO: 430 - DNA, 46 bp, Artificial Sequence
  Synthesized adaptor oligonucleotide
  misc_feature (34)..(36): n is a, c, g, or t
tgcaggaccagagaattcgaatacagacctcccnnntgcatcaggt

SEQ ID NO: 431 - DNA, 46 bp, Artificial Sequence
  Synthesized adaptor oligonucleotide
  misc_feature (34)..(36): n is a, c, g, or t
tgcaggaccagagaattcgaatacatggcaatcnnntgcatcaggt

SEQ ID NO: 432 - DNA, 46 bp, Artificial Sequence
  Synthesized adaptor oligonucleotide
  misc_feature (34)..(36): n is a, c, g, or t
tgcaggaccagagaattcgaatacatctccggcnnntgcatcaggt

SEQ ID NO: 433 - DNA, 46 bp, Artificial Sequence
  Synthesized adaptor oligonucleotide
  misc_feature (34)..(36): n is a, c, g, or t
tgcaggaccagagaattcgaatacaccagcgtgnnntgcatcaggt

SEQ ID NO: 434 - DNA, 46 bp, Artificial Sequence
  Synthesized adaptor oligonucleotide
  misc_feature (34)..(36): n is a, c, g, or t
tgcaggaccagagaattcgaatacaaaatataannntgcatcaggt

SEQ ID NO: 435 - DNA, 46 bp, Artificial Sequence
  Synthesized adaptor oligonucleotide
  misc_feature (34)..(36): n is a, c, g, or t
tgcaggaccagagaattcgaatacagcaatttannntgcatcaggt

SEQ ID NO: 436 - DNA, 46 bp, Artificial Sequence
  Synthesized adaptor oligonucleotide
  misc_feature (34)..(36): n is a, c, g, or t
tgcaggaccagagaattcgaatacaactcagtgnnntgcatcaggt

SEQ ID NO: 437 - DNA, 46 bp, Artificial Sequence
  Synthesized adaptor oligonucleotide
  misc_feature (34)..(36): n is a, c, g, or t
tgcaggaccagagaattcgaatacaagaggcatnnntgcatcaggt

SEQ ID NO: 438 - DNA, 46 bp, Artificial Sequence
  Synthesized adaptor oligonucleotide
  misc_feature (34)..(36): n is a, c, g, or t
tgcaggaccagagaattcgaatacataggcttgnnntgcatcaggt

SEQ ID NO: 439 - DNA, 46 bp, Artificial Sequence
  Synthesized adaptor oligonucleotide
  misc_feature (34)..(36): n is a, c, g, or t
tgcaggaccagagaattcgaatacacacacagtnnntgcatcaggt

SEQ ID NO: 440 - DNA, 46 bp, Artificial Sequence
  Synthesized adaptor oligonucleotide
  misc_feature (34)..(36): n is a, c, g, or t
tgcaggaccagagaattcgaatacatgatagaannntgcatcaggt

SEQ ID NO: 441 - DNA, 46 bp, Artificial Sequence
  Synthesized adaptor oligonucleotide
  misc_feature (34)..(36): n is a, c, g, or t
tgcaggaccagagaattcgaatacagacaacgannntgcatcaggt

SEQ ID NO: 442 - DNA, 46 bp, Artificial Sequence
  Synthesized adaptor oligonucleotide
  misc_feature (34)..(36): n is a, c, g, or t
tgcaggaccagagaattcgaatacactgcctcgnnntgcatcaggt

SEQ ID NO: 443 - DNA, 46 bp, Artificial Sequence
  Synthesized adaptor oligonucleotide
  misc_feature (34)..(36): n is a, c, g, or t
tgcaggaccagagaattcgaatacagtttcccannntgcatcaggt

SEQ ID NO: 444 - DNA, 46 bp, Artificial Sequence
  Synthesized adaptor oligonucleotide
  misc_feature (34)..(36): n is a, c, g, or t
tgcaggaccagagaattcgaatacattcaatagnnntgcatcaggt

SEQ ID NO: 445 - DNA, 46 bp, Artificial Sequence
  Synthesized adaptor oligonucleotide
  misc_feature (34)..(36): n is a, c, g, or t
tgcaggaccagagaattcgaatacatagccatgnnntgcatcaggt

SEQ ID NO: 446 - DNA, 46 bp, Artificial Sequence
  Synthesized adaptor oligonucleotide
  misc_feature (34)..(36): n is a, c, g, or t
tgcaggaccagagaattcgaatacagttgttaannntgcatcaggt

SEQ ID NO: 447 - DNA, 46 bp, Artificial Sequence
  Synthesized adaptor oligonucleotide
  misc_feature (34)..(36): n is a, c, g, or t
tgcaggaccagagaattcgaatacacttgcactnnntgcatcaggt

SEQ ID NO: 448 - DNA, 46 bp, Artificial Sequence
  Synthesized adaptor oligonucleotide
  misc_feature (34)..(36): n is a, c, g, or t
tgcaggaccagagaattcgaatacattagagccnnntgcatcaggt

SEQ ID NO: 449 - DNA, 46 bp, Artificial Sequence
  Synthesized adaptor oligonucleotide
  misc_feature (34)..(36): n is a, c, g, or t
tgcaggaccagagaattcgaatacagcccctacnnntgcatcaggt

SEQ ID NO: 450 - DNA, 46 bp, Artificial Sequence
  Synthesized adaptor oligonucleotide
  misc_feature (34)..(36): n is a, c, g, or t
tgcaggaccagagaattcgaatacaaatggacgnnntgcatcaggt

SEQ ID NO: 451 - DNA, 46 bp, Artificial Sequence
  Synthesized adaptor oligonucleotide
  misc_feature (34)..(36): n is a, c, g, or t
tgcaggaccagagaattcgaatacaagacctgtnnntgcatcaggt

SEQ ID NO: 452 - DNA, 46 bp, Artificial Sequence
  Synthesized adaptor oligonucleotide
  misc_feature (34)..(36): n is a, c, g, or t
tgcaggaccagagaattcgaatacacttacattnnntgcatcaggt

SEQ ID NO: 453 - DNA, 46 bp, Artificial Sequence
  Synthesized adaptor oligonucleotide
  misc_feature (34)..(36): n is a, c, g, or t
tgcaggaccagagaattcgaatacataagaaacnnntgcatcaggt

SEQ ID NO: 454 - DNA, 46 bp, Artificial Sequence
  Synthesized adaptor oligonucleotide
  misc_feature (34)..(36): n is a, c, g, or t
tgcaggaccagagaattcgaatacagattctttnnntgcatcaggt

SEQ ID NO: 455 - DNA, 46 bp, Artificial Sequence
  Synthesized adaptor oligonucleotide
  misc_feature (34)..(36): n is a, c, g, or t
tgcaggaccagagaattcgaatacatctaggtgnnntgcatcaggt

SEQ ID NO: 456 - DNA, 46 bp, Artificial Sequence
  Synthesized adaptor oligonucleotide
  misc_feature (34)..(36): n is a, c, g, or t
tgcaggaccagagaattcgaatacagtgtcttcnnntgcatcaggt

SEQ ID NO: 457 - DNA, 46 bp, Artificial Sequence
  Synthesized adaptor oligonucleotide
  misc_feature (34)..(36): n is a, c, g, or t
tgcaggaccagagaattcgaatacataaacttgnnntgcatcaggt

SEQ ID NO: 458 - DNA, 46 bp, Artificial Sequence
  Synthesized adaptor oligonucleotide
  misc_feature (34)..(36): n is a, c, g, or t
tgcaggaccagagaattcgaatacagacatccannntgcatcaggt

SEQ ID NO: 459 - DNA, 46 bp, Artificial Sequence
  Synthesized adaptor oligonucleotide
  misc_feature (34)..(36): n is a, c, g, or t
tgcaggaccagagaattcgaatacataagtccgnnntgcatcaggt

SEQ ID NO: 460 - DNA, 46 bp, Artificial Sequence
  Synthesized adaptor oligonucleotide
  misc_feature (34)..(36): n is a, c, g, or t
tgcaggaccagagaattcgaatacaaggcgcgannntgcatcaggt

SEQ ID NO: 461 - DNA, 46 bp, Artificial Sequence
  Synthesized adaptor oligonucleotide
  misc_feature (34)..(36): n is a, c, g, or t
tgcaggaccagagaattcgaatacagagctctannntgcatcaggt

SEQ ID NO: 462 - DNA, 46 bp, Artificial Sequence
  Synthesized adaptor oligonucleotide
  misc_feature (34)..(36): n is a, c, g, or t
tgcaggaccagagaattcgaatacatcataatgnnntgcatcaggt

SEQ ID NO: 463 - DNA, 46 bp, Artificial Sequence
  Synthesized adaptor oligonucleotide
  misc_feature (34)..(36): n is a, c, g, or t
tgcaggaccagagaattcgaatacaggatggtannntgcatcaggt

SEQ ID NO: 464 - DNA, 46 bp, Artificial Sequence
  Synthesized adaptor oligonucleotide
  misc_feature (34)..(36): n is a, c, g, or t
tgcaggaccagagaattcgaatacatagccttcnnntgcatcaggt

SEQ ID NO: 465 - DNA, 46 bp, Artificial Sequence
  Synthesized adaptor oligonucleotide
  misc_feature (34)..(36): n is a, c, g, or t
tgcaggaccagagaattcgaatacaatccccgcnnntgcatcaggt

SEQ ID NO: 466 - DNA, 46 bp, Artificial Sequence
  Synthesized adaptor oligonucleotide
  misc_feature (34)..(36): n is a, c, g, or t
tgcaggaccagagaattcgaatacagattgctgnnntgcatcaggt

SEQ ID NO: 467 - DNA, 46 bp, Artificial Sequence
  Synthesized adaptor oligonucleotide
  misc_feature (34)..(36): n is a, c, g, or t
tgcaggaccagagaattcgaatacagtgatgagnnntgcatcaggt

SEQ ID NO: 468 - DNA, 46 bp, Artificial Sequence
  Synthesized adaptor oligonucleotide
  misc_feature (34)..(36): n is a, c, g, or t
tgcaggaccagagaattcgaatacacggaacggnnntgcatcaggt

SEQ ID NO: 469 - DNA, 46 bp, Artificial Sequence
  Synthesized adaptor oligonucleotide
  misc_feature (34)..(36): n is a, c, g, or t
tgcaggaccagagaattcgaatacagctctttgnnntgcatcaggt

SEQ ID NO: 470 - DNA, 46 bp, Artificial Sequence
  Synthesized adaptor oligonucleotide
  misc_feature (34)..(36): n is a, c, g, or t
tgcaggaccagagaattcgaatacagtaatcgcnnntgcatcaggt

SEQ ID NO: 471 - DNA, 46 bp, Artificial Sequence
  Synthesized adaptor oligonucleotide
  misc_feature (34)..(36): n is a, c, g, or t
tgcaggaccagagaattcgaatacacttgttatnnntgcatcaggt

SEQ ID NO: 472 - DNA, 46 bp, Artificial Sequence
  Synthesized adaptor oligonucleotide
  misc_feature (34)..(36): n is a, c, g, or t
tgcaggaccagagaattcgaatacacacacacannntgcatcaggt

SEQ ID NO: 473 - DNA, 46 bp, Artificial Sequence
  Synthesized adaptor oligonucleotide
  misc_feature (34)..(36): n is a, c, g, or t
tgcaggaccagagaattcgaatacataaataaannntgcatcaggt

SEQ ID NO: 474 - DNA, 46 bp, Artificial Sequence
  Synthesized adaptor oligonucleotide
  misc_feature (34)..(36): n is a, c, g, or t
tgcaggaccagagaattcgaatacaaacgcatcnnntgcatcaggt

SEQ ID NO: 475 - DNA, 46 bp, Artificial Sequence
  Synthesized adaptor oligonucleotide
  misc_feature (34)..(36): n is a, c, g, or t
tgcaggaccagagaattcgaatacacatatgatnnntgcatcaggt

SEQ ID NO: 476 - DNA, 46 bp, Artificial Sequence
  Synthesized adaptor oligonucleotide
  misc_feature (34)..(36): n is a, c, g, or t
tgcaggaccagagaattcgaatacagcgtcatannntgcatcaggt

SEQ ID NO: 477 - DNA, 46 bp, Artificial Sequence
  Synthesized adaptor oligonucleotide
  misc_feature (34)..(36): n is a, c, g, or t
tgcaggaccagagaattcgaatacataagcctgnnntgcatcaggt

SEQ ID NO: 478 - DNA, 46 bp, Artificial Sequence
  Synthesized adaptor oligonucleotide
  misc_feature (34)..(36): n is a, c, g, or t
tgcaggaccagagaattcgaatacatagcagagnnntgcatcaggt

SEQ ID NO: 479 - DNA, 46 bp, Artificial Sequence
  Synthesized adaptor oligonucleotide
  misc_feature (34)..(36): n is a, c, g, or t
tgcaggaccagagaattcgaatacacttggaacnnntgcatcaggt

SEQ ID NO: 480 - DNA, 46 bp, Artificial Sequence
  Synthesized adaptor oligonucleotide
  misc_feature (34)..(36): n is a, c, g, or t
tgcaggaccagagaattcgaatacaaccgagaannntgcatcaggt

SEQ ID NO: 481 - DNA, 46 bp, Artificial Sequence
  Synthesized adaptor oligonucleotide
  misc_feature (34)..(36): n is a, c, g, or t
tgcaggaccagagaattcgaatacactatctatnnntgcatcaggt

SEQ ID NO: 482 - DNA, 46 bp, Artificial Sequence
  Synthesized adaptor oligonucleotide
  misc_feature (34)..(36): n is a, c, g, or t
tgcaggaccagagaattcgaatacacaatttagnnntgcatcaggt

SEQ ID NO: 483 - DNA, 46 bp, Artificial Sequence
  Synthesized adaptor oligonucleotide
  misc_feature (34)..(36): n is a, c, g, or t
tgcaggaccagagaattcgaatacactaaacgcnnntgcatcaggt

SEQ ID NO: 484 - DNA, 46 bp, Artificial Sequence
  Synthesized adaptor oligonucleotide
  misc_feature (34)..(36): n is a, c, g, or t
tgcaggaccagagaattcgaatacatagtagaannntgcatcaggt

SEQ ID NO: 485 - DNA, 46 bp, Artificial Sequence
  Synthesized adaptor oligonucleotide
  misc_feature (34)..(36): n is a, c, g, or t
tgcaggaccagagaattcgaatacagcaaagtgnnntgcatcaggt

SEQ ID NO: 486 - DNA, 46 bp, Artificial Sequence
  Synthesized adaptor oligonucleotide
  misc_feature (34)..(36): n is a, c, g, or t
tgcaggaccagagaattcgaatacacaagttatnnntgcatcaggt

SEQ ID NO: 487 - DNA, 46 bp, Artificial Sequence
  Synthesized adaptor oligonucleotide
  misc_feature (34)..(36): n is a, c, g, or t
tgcaggaccagagaattcgaatacacaactgacnnntgcatcaggt

SEQ ID NO: 488 - DNA, 46 bp, Artificial Sequence
  Synthesized adaptor oligonucleotide
  misc_feature (34)..(36): n is a, c, g, or t
tgcaggaccagagaattcgaatacattcgtcgtnnntgcatcaggt

SEQ ID NO: 489 - DNA, 46 bp, Artificial Sequence
  Synthesized adaptor oligonucleotide
  misc_feature (34)..(36): n is a, c, g, or t
tgcaggaccagagaattcgaatacaacgtcaacnnnacgtatgcca

SEQ ID NO: 490 - DNA, 46 bp, Artificial Sequence
  Synthesized adaptor oligonucleotide
  misc_feature (34)..(36): n is a, c, g, or t
tgcaggaccagagaattcgaatacagtgtctagnnnacgtatgcca

SEQ ID NO: 491 - DNA, 46 bp, Artificial Sequence
  Synthesized adaptor oligonucleotide
  misc_feature (34)..(36): n is a, c, g, or t
tgcaggaccagagaattcgaatacagcgccagtnnnacgtatgcca

SEQ ID NO: 492 - DNA, 46 bp, Artificial Sequence
  Synthesized adaptor oligonucleotide
  misc_feature (34)..(36): n is a, c, g, or t
tgcaggaccagagaattcgaatacagctctgaannnacgtatgcca

SEQ ID NO: 493 - DNA, 46 bp, Artificial Sequence
  Synthesized adaptor oligonucleotide
  misc_feature (34)..(36): n is a, c, g, or t
tgcaggaccagagaattcgaatacaagacttgcnnnacgtatgcca

SEQ ID NO: 494 - DNA, 46 bp, Artificial Sequence
  Synthesized adaptor oligonucleotide
  misc_feature (34)..(36): n is a, c, g, or t
tgcaggaccagagaattcgaatacagatggtctnnnacgtatgcca

SEQ ID NO: 495 - DNA, 46 bp, Artificial Sequence
  Synthesized adaptor oligonucleotide
  misc_feature (34)..(36): n is a, c, g, or t
tgcaggaccagagaattcgaatacattgtgaatnnnacgtatgcca

SEQ ID NO: 496 - DNA, 46 bp, Artificial Sequence
  Synthesized adaptor oligonucleotide
  misc_feature (34)..(36): n is a, c, g, or t
tgcaggaccagagaattcgaatacacagcgcgtnnnacgtatgcca

SEQ ID NO: 497 - DNA, 46 bp, Artificial Sequence
  Synthesized adaptor oligonucleotide
  misc_feature (34)..(36): n is a, c, g, or t
tgcaggaccagagaattcgaatacatgccaagtnnnacgtatgcca

SEQ ID NO: 498 - DNA, 46 bp, Artificial Sequence
  Synthesized adaptor oligonucleotide
  misc_feature (34)..(36): n is a, c, g, or t
tgcaggaccagagaattcgaatacacgtcgtttnnnacgtatgcca

SEQ ID NO: 499 - DNA, 46 bp, Artificial Sequence
  Synthesized adaptor oligonucleotide
  misc_feature (34)..(36): n is a, c, g, or t
tgcaggaccagagaattcgaatacaccaacggcnnnacgtatgcca

SEQ ID NO: 500 - DNA, 46 bp, Artificial Sequence
  Synthesized adaptor oligonucleotide
  misc_feature (34)..(36): n is a, c, g, or t
tgcaggaccagagaattcgaatacacagttatannnacgtatgcca

SEQ ID NO: 501 - DNA, 46 bp, Artificial Sequence
  Synthesized adaptor oligonucleotide
  misc_feature (34)..(36): n is a, c, g, or t
tgcaggaccagagaattcgaatacacgaaggcgnnnacgtatgcca

SEQ ID NO: 502 - DNA, 46 bp, Artificial Sequence
  Synthesized adaptor oligonucleotide
  misc_feature (34)..(36): n is a, c, g, or t
tgcaggaccagagaattcgaatacaatggctacnnnacgtatgcca

SEQ ID NO: 503 - DNA, 46 bp, Artificial Sequence
  Synthesized adaptor oligonucleotide
  misc_feature (34)..(36): n is a, c, g, or t
tgcaggaccagagaattcgaatacatcgcatgannnacgtatgcca

SEQ ID NO: 504 - DNA, 46 bp, Artificial Sequence
  Synthesized adaptor oligonucleotide
  misc_feature (34)..(36): n is a, c, g, or t
tgcaggaccagagaattcgaatacaatatccttnnnacgtatgcca

SEQ ID NO: 505 - DNA, 46 bp, Artificial Sequence
  Synthesized adaptor oligonucleotide
  misc_feature (34)..(36): n is a, c, g, or t
tgcaggaccagagaattcgaatacatgaagcagnnnacgtatgcca

SEQ ID NO: 506 - DNA, 46 bp, Artificial Sequence
  Synthesized adaptor oligonucleotide
  misc_feature (34)..(36): n is a, c, g, or t
tgcaggaccagagaattcgaatacagaccaccgnnnacgtatgcca

SEQ ID NO: 507 - DNA, 46 bp, Artificial Sequence
  Synthesized adaptor oligonucleotide
  misc_feature (34)..(36): n is a, c, g, or t
tgcaggaccagagaattcgaatacaagattagannnacgtatgcca

SEQ ID NO: 508 - DNA, 46 bp, Artificial Sequence
  Synthesized adaptor oligonucleotide
  misc_feature (34)..(36): n is a, c, g, or t
tgcaggaccagagaattcgaatacaagatctatnnnacgtatgcca

SEQ ID NO: 509 - DNA, 46 bp, Artificial Sequence
  Synthesized adaptor oligonucleotide
  misc_feature (34)..(36): n is a, c, g, or t
tgcaggaccagagaattcgaatacaacgtacacnnnacgtatgcca

SEQ ID NO: 510 - DNA, 46 bp, Artificial Sequence
  Synthesized adaptor oligonucleotide
  misc_feature (34)..(36): n is a, c, g, or t
tgcaggaccagagaattcgaatacacggttacannnacgtatgcca

SEQ ID NO: 511 - DNA, 46 bp, Artificial Sequence
  Synthesized adaptor oligonucleotide
  misc_feature (34)..(36): n is a, c, g, or t
tgcaggaccagagaattcgaatacaaaacctatnnnacgtatgcca

SEQ ID NO: 512 - DNA, 46 bp, Artificial Sequence
  Synthesized adaptor oligonucleotide
  misc_feature (34)..(36): n is a, c, g, or t
tgcaggaccagagaattcgaatacactgattttnnnacgtatgcca

SEQ ID NO: 513 - DNA, 46 bp, Artificial Sequence
  Synthesized adaptor oligonucleotide
  misc_feature (34)..(36): n is a, c, g, or t
tgcaggaccagagaattcgaatacatgaatatcnnnacgtatgcca

SEQ ID NO: 514 - DNA, 46 bp, Artificial Sequence
  Synthesized adaptor oligonucleotide
  misc_feature (34)..(36): n is a, c, g, or t
tgcaggaccagagaattcgaatacaactgcgcgnnnacgtatgcca

SEQ ID NO: 515 - DNA, 46 bp, Artificial Sequence
  Synthesized adaptor oligonucleotide
  misc_feature (34)..(36): n is a, c, g, or t
tgcaggaccagagaattcgaatacagaacgacannnacgtatgcca

SEQ ID NO: 516 - DNA, 46 bp, Artificial Sequence
  Synthesized adaptor oligonucleotide
  misc_feature (34)..(36): n is a, c, g, or t
tgcaggaccagagaattcgaatacatatattggnnnacgtatgcca

SEQ ID NO: 517 - DNA, 46 bp, Artificial Sequence
  Synthesized adaptor oligonucleotide
  misc_feature (34)..(36): n is a, c, g, or t
tgcaggaccagagaattcgaatacatagatgccnnnacgtatgcca

SEQ ID NO: 518 - DNA, 46 bp, Artificial Sequence
  Synthesized adaptor oligonucleotide
  misc_feature (34)..(36): n is a, c, g, or t
tgcaggaccagagaattcgaatacagcaagtagnnnacgtatgcca

SEQ ID NO: 519 - DNA, 46 bp, Artificial Sequence
  Synthesized adaptor oligonucleotide
  misc_feature (34)..(36): n is a, c, g, or t
tgcaggaccagagaattcgaatacaaacgacctnnnacgtatgcca

SEQ ID NO: 520 - DNA, 46 bp, Artificial Sequence
  Synthesized adaptor oligonucleotide
  misc_feature (34)..(36): n is a, c, g, or t
tgcaggaccagagaattcgaatacagtacagtcnnnacgtatgcca

SEQ ID NO: 521 - DNA, 46 bp, Artificial Sequence
  Synthesized adaptor oligonucleotide
  misc_feature (34)..(36): n is a, c, g, or t
tgcaggaccagagaattcgaatacatatgcggtnnnacgtatgcca

SEQ ID NO: 522 - DNA, 46 bp, Artificial Sequence
  Synthesized adaptor oligonucleotide
  misc_feature (34)..(36): n is a, c, g, or t
tgcaggaccagagaattcgaatacaataataggnnnacgtatgcca

SEQ ID NO: 523 - DNA, 46 bp, Artificial Sequence
  Synthesized adaptor oligonucleotide
  misc_feature (34)..(36): n is a, c, g, or t
tgcaggaccagagaattcgaatacagttactaannnacgtatgcca

SEQ ID NO: 524 - DNA, 46 bp, Artificial Sequence
  Synthesized adaptor oligonucleotide
  misc_feature (34)..(36): n is a, c, g, or t
tgcaggaccagagaattcgaatacacccttgtannnacgtatgcca

SEQ ID NO: 525 - DNA, 46 bp, Artificial Sequence
  Synthesized adaptor oligonucleotide
  misc_feature (34)..(36): n is a, c, g, or t
tgcaggaccagagaattcgaatacaacatttctnnnacgtatgcca

SEQ ID NO: 526 - DNA, 46 bp, Artificial Sequence
  Synthesized adaptor oligonucleotide
  misc_feature (34)..(36): n is a, c, g, or t
tgcaggaccagagaattcgaatacaccgactttnnnacgtatgcca

SEQ ID NO: 527 - DNA, 46 bp, Artificial Sequence
  Synthesized adaptor oligonucleotide
  misc_feature (34)..(36): n is a, c, g, or t
tgcaggaccagagaattcgaatacatatgaactnnnacgtatgcca

SEQ ID NO: 528 - DNA, 46 bp, Artificial Sequence
  Synthesized adaptor oligonucleotide
  misc_feature (34)..(36): n is a, c, g, or t
tgcaggaccagagaattcgaatacattcttttcnnnacgtatgcca

SEQ ID NO: 529 - DNA, 46 bp, Artificial Sequence
  Synthesized adaptor oligonucleotide
  misc_feature (34)..(36): n is a, c, g, or t
tgcaggaccagagaattcgaatacaataggtttnnnacgtatgcca

SEQ ID NO: 530 - DNA, 46 bp, Artificial Sequence
  Synthesized adaptor oligonucleotide
  misc_feature (34)..(36): n is a, c, g, or t
tgcaggaccagagaattcgaatacacgacgttannnacgtatgcca

SEQ ID NO: 531 - DNA, 46 bp, Artificial Sequence
  Synthesized adaptor oligonucleotide
  misc_feature (34)..(36): n is a, c, g, or t
tgcaggaccagagaattcgaatacaagcataggnnnacgtatgcca

SEQ ID NO: 532 - DNA, 46 bp, Artificial Sequence
  Synthesized adaptor oligonucleotide
  misc_feature (34)..(36): n is a, c, g, or t
tgcaggaccagagaattcgaatacactgcatctnnnacgtatgcca

SEQ ID NO: 533 - DNA, 46 bp, Artificial Sequence
  Synthesized adaptor oligonucleotide
  misc_feature (34)..(36): n is a, c, g, or t
tgcaggaccagagaattcgaatacacgacgccannnacgtatgcca

SEQ ID NO: 534 - DNA, 46 bp, Artificial Sequence
  Synthesized adaptor oligonucleotide
  misc_feature (34)..(36): n is a, c, g, or t
tgcaggaccagagaattcgaatacaaacgcccgnnnacgtatgcca

SEQ ID NO: 535 - DNA, 46 bp, Artificial Sequence
  Synthesized adaptor oligonucleotide
  misc_feature (34)..(36): n is a, c, g, or t
tgcaggaccagagaattcgaatacactctcgatnnnacgtatgcca

SEQ ID NO: 536 - DNA, 46 bp, Artificial Sequence
  Synthesized adaptor oligonucleotide
  misc_feature (34)..(36): n is a, c, g, or t
tgcaggaccagagaattcgaatacaccctgaccnnnacgtatgcca

SEQ ID NO: 537 - DNA, 46 bp, Artificial Sequence
  Synthesized adaptor oligonucleotide
  misc_feature (34)..(36): n is a, c, g, or t
tgcaggaccagagaattcgaatacagttgtaatnnnacgtatgcca

SEQ ID NO: 538 - DNA, 46 bp, Artificial Sequence
  Synthesized adaptor oligonucleotide
  misc_feature (34)..(36): n is a, c, g, or t
tgcaggaccagagaattcgaatacaaaaagactnnnacgtatgcca

SEQ ID NO: 539 - DNA, 46 bp, Artificial Sequence
  Synthesized adaptor oligonucleotide
  misc_feature (34)..(36): n is a, c, g, or t
tgcaggaccagagaattcgaatacatcctagctnnnacgtatgcca

SEQ ID NO: 540 - DNA, 46 bp, Artificial Sequence
  Synthesized adaptor oligonucleotide
  misc_feature (34)..(36): n is a, c, g, or t
tgcaggaccagagaattcgaatacaaccaaaggnnnacgtatgcca

SEQ ID NO: 541 - DNA, 46 bp, Artificial Sequence
  Synthesized adaptor oligonucleotide
  misc_feature (34)..(36): n is a, c, g, or t
tgcaggaccagagaattcgaatacaacgagttcnnnacgtatgcca

SEQ ID NO: 542 - DNA, 46 bp, Artificial Sequence
  Synthesized adaptor oligonucleotide
  misc_feature (34)..(36): n is a, c, g, or t
tgcaggaccagagaattcgaatacactatggtgnnnacgtatgcca

SEQ ID NO: 543 - DNA, 46 bp, Artificial Sequence
  Synthesized adaptor oligonucleotide
  misc_feature (34)..(36): n is a, c, g, or t
tgcaggaccagagaattcgaatacaccaccgtcnnnacgtatgcca

SEQ ID NO: 544 - DNA, 46 bp, Artificial Sequence
  Synthesized adaptor oligonucleotide
  misc_feature (34)..(36): n is a, c, g, or t
tgcaggaccagagaattcgaatacagaatcgctnnnacgtatgcca

SEQ ID NO: 545 - DNA, 46 bp, Artificial Sequence
  Synthesized adaptor oligonucleotide
  misc_feature (34)..(36): n is a, c, g, or t
tgcaggaccagagaattcgaatacaagtgttatnnnacgtatgcca

SEQ ID NO: 546 - DNA, 46 bp, Artificial Sequence
  Synthesized adaptor oligonucleotide
  misc_feature (34)..(36): n is a, c, g, or t
tgcaggaccagagaattcgaatacaacgcgtcgnnnacgtatgcca

SEQ ID NO: 547 - DNA, 46 bp, Artificial Sequence
  Synthesized adaptor oligonucleotide
  misc_feature (34)..(36): n is a, c, g, or t
tgcaggaccagagaattcgaatacactcgtgttnnnacgtatgcca

SEQ ID NO: 548 - DNA, 46 bp, Artificial Sequence
  Synthesized adaptor oligonucleotide
  misc_feature (34)..(36): n is a, c, g, or t
tgcaggaccagagaattcgaatacattgtagatnnnacgtatgcca

SEQ ID NO: 549 - DNA, 46 bp, Artificial Sequence
  Synthesized adaptor oligonucleotide
  misc_feature (34)..(36): n is a, c, g, or t
tgcaggaccagagaattcgaatacagccgcagtnnnctagcgttac

SEQ ID NO: 550 - DNA, 46 bp, Artificial Sequence
  Synthesized adaptor oligonucleotide
  misc_feature (34)..(36): n is a, c, g, or t
tgcaggaccagagaattcgaatacaagtgacgannnctagcgttac

SEQ ID NO: 551 - DNA, 46 bp, Artificial Sequence
  Synthesized adaptor oligonucleotide
  misc_feature (34)..(36): n is a, c, g, or t
tgcaggaccagagaattcgaatacaatacctccnnnctagcgttac

SEQ ID NO: 552 - DNA, 46 bp, Artificial Sequence
  Synthesized adaptor oligonucleotide
  misc_feature (34)..(36): n is a, c, g, or t
tgcaggaccagagaattcgaatacactttttgannnctagcgttac

SEQ ID NO: 553 - DNA, 46 bp, Artificial Sequence
  Synthesized adaptor oligonucleotide
  misc_feature (34)..(36): n is a, c, g, or t
tgcaggaccagagaattcgaatacaatatcatgnnnctagcgttac

SEQ ID NO: 554 - DNA, 46 bp, Artificial Sequence
  Synthesized adaptor oligonucleotide
  misc_feature (34)..(36): n is a, c, g, or t
tgcaggaccagagaattcgaatacatacatatgnnnctagcgttac

SEQ ID NO: 555 - DNA, 46 bp, Artificial Sequence
  Synthesized adaptor oligonucleotide
  misc_feature (34)..(36): n is a, c, g, or t
tgcaggaccagagaattcgaatacaacttttgtnnnctagcgttac

SEQ ID NO: 556 - DNA, 46 bp, Artificial Sequence
  Synthesized adaptor oligonucleotide
  misc_feature (34)..(36): n is a, c, g, or t
tgcaggaccagagaattcgaatacataatgtacnnnctagcgttac

SEQ ID NO: 557 - DNA, 46 bp, Artificial Sequence
  Synthesized adaptor oligonucleotide
  misc_feature (34)..(36): n is a, c, g, or t
tgcaggaccagagaattcgaatacaaacgacagnnnctagcgttac

SEQ ID NO: 558 - DNA, 46 bp, Artificial Sequence
  Synthesized adaptor oligonucleotide
  misc_feature (34)..(36): n is a, c, g, or t
tgcaggaccagagaattcgaatacagctcctatnnnctagcgttac

SEQ ID NO: 559 - DNA, 46 bp, Artificial Sequence
  Synthesized adaptor oligonucleotide
  misc_feature (34)..(36): n is a, c, g, or t
tgcaggaccagagaattcgaatacaccgaaactnnnctagcgttac

SEQ ID NO: 560 - DNA, 46 bp, Artificial Sequence
  Synthesized adaptor oligonucleotide
  misc_feature (34)..(36): n is a, c, g, or t
tgcaggaccagagaattcgaatacagctaggaannnctagcgttac

SEQ ID NO: 561 - DNA, 46 bp, Artificial Sequence
  Synthesized adaptor oligonucleotide
  misc_feature (34)..(36): n is a, c, g, or t
tgcaggaccagagaattcgaatacagcttccgcnnnctagcgttac

SEQ ID NO: 562 - DNA, 46 bp, Artificial Sequence
  Synthesized adaptor oligonucleotide
  misc_feature (34)..(36): n is a, c, g, or t
tgcaggaccagagaattcgaatacaacagcatcnnnctagcgttac

SEQ ID NO: 563 - DNA, 46 bp, Artificial Sequence
  Synthesized adaptor oligonucleotide
  misc_feature (34)..(36): n is a, c, g, or t
tgcaggaccagagaattcgaatacaacgagagtnnnctagcgttac

SEQ ID NO: 564 - DNA, 46 bp, Artificial Sequence
  Synthesized adaptor oligonucleotide
  misc_feature (34)..(36): n is a, c, g, or t
tgcaggaccagagaattcgaatacaatcatatgnnnctagcgttac

SEQ ID NO: 565 - DNA, 46 bp, Artificial Sequence
  Synthesized adaptor oligonucleotide
  misc_feature (34)..(36): n is a, c, g, or t
tgcaggaccagagaattcgaatacatgagatttnnnctagcgttac

SEQ ID NO: 566 - DNA, 46 bp, Artificial Sequence
  Synthesized adaptor oligonucleotide
  misc_feature (34)..(36): n is a, c, g, or t
tgcaggaccagagaattcgaatacagccggccgnnnctagcgttac

SEQ ID NO: 567 - DNA, 46 bp, Artificial Sequence
  Synthesized adaptor oligonucleotide
  misc_feature (34)..(36): n is a, c, g, or t
tgcaggaccagagaattcgaatacaaggcgcagnnnctagcgttac

SEQ ID NO: 568 - DNA, 46 bp, Artificial Sequence
  Synthesized adaptor oligonucleotide
  misc_feature (34)..(36): n is a, c, g, or t
tgcaggaccagagaattcgaatacagtacacacnnnctagcgttac

SEQ ID NO: 569 - DNA, 46 bp, Artificial Sequence
  Synthesized adaptor oligonucleotide
  misc_feature (34)..(36): n is a, c, g, or t
tgcaggaccagagaattcgaatacaagatttcannnctagcgttac

SEQ ID NO: 570 - DNA, 46 bp, Artificial Sequence
  Synthesized adaptor oligonucleotide
  misc_feature (34)..(36): n is a, c, g, or t
tgcaggaccagagaattcgaatacatgcatctcnnnctagcgttac

SEQ ID NO: 571 - DNA, 46 bp, Artificial Sequence
  Synthesized adaptor oligonucleotide
  misc_feature (34)..(36): n is a, c, g, or t
tgcaggaccagagaattcgaatacactcagagtnnnctagcgttac

SEQ ID NO: 572 - DNA, 46 bp, Artificial Sequence
  Synthesized adaptor oligonucleotide
  misc_feature (34)..(36): n is a, c, g, or t
tgcaggaccagagaattcgaatacaactctgtcnnnctagcgttac

SEQ ID NO: 573 - DNA, 46 bp, Artificial Sequence
  Synthesized adaptor oligonucleotide
  misc_feature (34)..(36): n is a, c, g, or t
tgcaggaccagagaattcgaatacattatccgcnnnctagcgttac

SEQ ID NO: 574 - DNA, 46 bp, Artificial Sequence
  Synthesized adaptor oligonucleotide
  misc_feature (34)..(36): n is a, c, g, or t
tgcaggaccagagaattcgaatacagcccttgcnnnctagcgttac

SEQ ID NO: 575 - DNA, 46 bp, Artificial Sequence
  Synthesized adaptor oligonucleotide
  misc_feature (34)..(36): n is a, c, g, or t
tgcaggaccagagaattcgaatacaaacttcttnnnctagcgttac

SEQ ID NO: 576 - DNA, 46 bp, Artificial Sequence
  Synthesized adaptor oligonucleotide
  misc_feature (34)..(36): n is a, c, g, or t
tgcaggaccagagaattcgaatacattgtaggcnnnctagcgttac

SEQ ID NO: 577 - DNA, 46 bp, Artificial Sequence
  Synthesized adaptor oligonucleotide
  misc_feature (34)..(36): n is a, c, g, or t
tgcaggaccagagaattcgaatacatgacccaannnctagcgttac

SEQ ID NO: 578 - DNA, 46 bp, Artificial Sequence
  Synthesized adaptor oligonucleotide
  misc_feature (34)..(36): n is a, c, g, or t
tgcaggaccagagaattcgaatacacctctgtannnctagcgttac

SEQ ID NO: 579 - DNA, 46 bp, Artificial Sequence
  Synthesized adaptor oligonucleotide
  misc_feature (34)..(36): n is a, c, g, or t
tgcaggaccagagaattcgaatacaagccactannnctagcgttac

SEQ ID NO: 580 - DNA, 46 bp, Artificial Sequence
  Synthesized adaptor oligonucleotide
  misc_feature (34)..(36): n is a, c, g, or t
tgcaggaccagagaattcgaatacatgtatgatnnnctagcgttac

SEQ ID NO: 581 - DNA, 46 bp, Artificial Sequence
  Synthesized adaptor oligonucleotide
  misc_feature (34)..(36): n is a, c, g, or t
tgcaggaccagagaattcgaatacacaggtcgcnnnctagcgttac

SEQ ID NO: 582 - DNA, 46 bp, Artificial Sequence
  Synthesized adaptor oligonucleotide
  misc_feature (34)..(36): n is a, c, g, or t
tgcaggaccagagaattcgaatacattttttttnnnctagcgttac

SEQ ID NO: 583 - DNA, 46 bp, Artificial Sequence
  Synthesized adaptor oligonucleotide
  misc_feature (34)..(36): n is a, c, g, or t
tgcaggaccagagaattcgaatacatttgcggannnctagcgttac

SEQ ID NO: 584 - DNA, 46 bp, Artificial Sequence
  Synthesized adaptor oligonucleotide
  misc_feature (34)..(36): n is a, c, g, or t
tgcaggaccagagaattcgaatacaagcctgtannnctagcgttac

SEQ ID NO: 585 - DNA, 46 bp, Artificial Sequence
  Synthesized adaptor oligonucleotide
  misc_feature (34)..(36): n is a, c, g, or t
tgcaggaccagagaattcgaatacagcggcactnnnctagcgttac

SEQ ID NO: 586 - DNA, 46 bp, Artificial Sequence
  Synthesized adaptor oligonucleotide
  misc_feature (34)..(36): n is a, c, g, or t
tgcaggaccagagaattcgaatacatgttgagcnnnctagcgttac

SEQ ID NO: 587 - DNA, 46 bp, Artificial Sequence
  Synthesized adaptor oligonucleotide
  misc_feature (34)..(36): n is a, c, g, or t
tgcaggaccagagaattcgaatacaaaaagttgnnnctagcgttac

SEQ ID NO: 588 - DNA, 46 bp, Artificial Sequence
  Synthesized adaptor oligonucleotide
  misc_feature (34)..(36): n is a, c, g, or t
tgcaggaccagagaattcgaatacacggtgccannnctagcgttac

SEQ ID NO: 589 - DNA, 46 bp, Artificial Sequence
  Synthesized adaptor oligonucleotide
  misc_feature (34)..(36): n is a, c, g, or t
tgcaggaccagagaattcgaatacacagcggtcnnnctagcgttac

SEQ ID NO: 590 - DNA, 46 bp, Artificial Sequence
  Synthesized adaptor oligonucleotide
  misc_feature (34)..(36): n is a, c, g, or t
tgcaggaccagagaattcgaatacaagctaaccnnnctagcgttac

SEQ ID NO: 591 - DNA, 46 bp, Artificial Sequence
  Synthesized adaptor oligonucleotide
  misc_feature (34)..(36): n is a, c, g, or t
tgcaggaccagagaattcgaatacaacggcgtcnnnctagcgttac

SEQ ID NO: 592 - DNA, 46 bp, Artificial Sequence
  Synthesized adaptor oligonucleotide
  misc_feature (34)..(36): n is a, c, g, or t
tgcaggaccagagaattcgaatacatagttcaannnctagcgttac

SEQ ID NO: 593 - DNA, 46 bp, Artificial Sequence
  Synthesized adaptor oligonucleotide
  misc_feature (34)..(36): n is a, c, g, or t
tgcaggaccagagaattcgaatacaatgtagccnnnctagcgttac

SEQ ID NO: 594 - DNA, 46 bp, Artificial Sequence
  Synthesized adaptor oligonucleotide
  misc_feature (34)..(36): n is a, c, g, or t
tgcaggaccagagaattcgaatacaagaagcacnnnctagcgttac

SEQ ID NO: 595 - DNA, 46 bp, Artificial Sequence
  Synthesized adaptor oligonucleotide
  misc_feature (34)..(36): n is a, c, g, or t
tgcaggaccagagaattcgaatacagaagcgcgnnnctagcgttac

SEQ ID NO: 596 - DNA, 46 bp, Artificial Sequence
  Synthesized adaptor oligonucleotide
  misc_feature (34)..(36): n is a, c, g, or t
tgcaggaccagagaattcgaatacacggtatacnnnctagcgttac

SEQ ID NO: 597 - DNA, 46 bp, Artificial Sequence
  Synthesized adaptor oligonucleotide
  misc_feature (34)..(36): n is a, c, g, or t
tgcaggaccagagaattcgaatacataacatacnnnctagcgttac

SEQ ID NO: 598 - DNA, 46 bp, Artificial Sequence
  Synthesized adaptor oligonucleotide
  misc_feature (34)..(36): n is a, c, g, or t
tgcaggaccagagaattcgaatacactgctatcnnnctagcgttac

SEQ ID NO: 599 - DNA, 46 bp, Artificial Sequence
  Synthesized adaptor oligonucleotide
  misc_feature (34)..(36): n is a, c, g, or t
tgcaggaccagagaattcgaatacacggcaaccnnnctagcgttac

SEQ ID NO: 600 - DNA, 46 bp, Artificial Sequence
  Synthesized adaptor oligonucleotide
  misc_feature (34)..(36): n is a, c, g, or t
tgcaggaccagagaattcgaatacacaaaaacannnctagcgttac

SEQ ID NO: 601 - DNA, 46 bp, Artificial Sequence
  Synthesized adaptor oligonucleotide
  misc_feature (34)..(36): n is a, c, g, or t
tgcaggaccagagaattcgaatacacgttagcannnctagcgttac

SEQ ID NO: 602 - DNA, 46 bp, Artificial Sequence
  Synthesized adaptor oligonucleotide
  misc_feature (34)..(36): n is a, c, g, or t
tgcaggaccagagaattcgaatacaccctaatcnnnctagcgttac

SEQ ID NO: 603 - DNA, 46 bp, Artificial Sequence
  Synthesized adaptor oligonucleotide
  misc_feature (34)..(36): n is a, c, g, or t
tgcaggaccagagaattcgaatacatgtggccgnnnctagcgttac

SEQ ID NO: 604 - DNA, 46 bp, Artificial Sequence
  Synthesized adaptor oligonucleotide
  misc_feature (34)..(36): n is a, c, g, or t
tgcaggaccagagaattcgaatacatctagagcnnnctagcgttac

SEQ ID NO: 605 - DNA, 46 bp, Artificial Sequence
  Synthesized adaptor oligonucleotide
  misc_feature (34)..(36): n is a, c, g, or t
tgcaggaccagagaattcgaatacatacgcatgnnnctagcgttac

SEQ ID NO: 606 - DNA, 46 bp, Artificial Sequence
  Synthesized adaptor oligonucleotide
  misc_feature (34)..(36): n is a, c, g, or t
tgcaggaccagagaattcgaatacattgccccgnnnctagcgttac

SEQ ID NO: 607 - DNA, 46 bp, Artificial Sequence
  Synthesized adaptor oligonucleotide
  misc_feature (34)..(36): n is a, c, g, or t
tgcaggaccagagaattcgaatacatggttcctnnnctagcgttac

SEQ ID NO: 608 - DNA, 46 bp, Artificial Sequence
  Synthesized adaptor oligonucleotide
  misc_feature (34)..(36): n is a, c, g, or t
tgcaggaccagagaattcgaatacaaacggtgannnctagcgttac

SEQ ID NO: 609 - DNA, 46 bp, Artificial Sequence
  Synthesized adaptor oligonucleotide
  misc_feature (34)..(36): n is a, c, g, or t
tgcaggaccagagaattcgaatacaggctatacnnngatcgacatg

SEQ ID NO: 610 - DNA, 46 bp, Artificial Sequence
  Synthesized adaptor oligonucleotide
  misc_feature (34)..(36): n is a, c, g, or t
tgcaggaccagagaattcgaatacaattggttannngatcgacatg

SEQ ID NO: 611 - DNA, 46 bp, Artificial Sequence
  Synthesized adaptor oligonucleotide
  misc_feature (34)..(36): n is a, c, g, or t
tgcaggaccagagaattcgaatacacaggatgannngatcgacatg

SEQ ID NO: 612 - DNA, 46 bp, Artificial Sequence
  Synthesized adaptor oligonucleotide
  misc_feature (34)..(36): n is a, c, g, or t
tgcaggaccagagaattcgaatacacgttatccnnngatcgacatg

SEQ ID NO: 613 - DNA, 46 bp, Artificial Sequence
  Synthesized adaptor oligonucleotide
  misc_feature (34)..(36): n is a, c, g, or t
tgcaggaccagagaattcgaatacagttcaatannngatcgacatg

SEQ ID NO: 614 - DNA, 46 bp, Artificial Sequence
  Synthesized adaptor oligonucleotide
  misc_feature (34)..(36): n is a, c, g, or t
tgcaggaccagagaattcgaatacacaaaatctnnngatcgacatg

SEQ ID NO: 615 - DNA, 46 bp, Artificial Sequence
  Synthesized adaptor oligonucleotide
  misc_feature (34)..(36): n is a, c, g, or t
tgcaggaccagagaattcgaatacactgcaaacnnngatcgacatg

SEQ ID NO: 616 - DNA, 46 bp, Artificial Sequence
  Synthesized adaptor oligonucleotide
  misc_feature (34)..(36): n is a, c, g, or t
tgcaggaccagagaattcgaatacaggtgcccannngatcgacatg

SEQ ID NO: 617 - DNA, 46 bp, Artificial Sequence
  Synthesized adaptor oligonucleotide
  misc_feature (34)..(36): n is a, c, g, or t
tgcaggaccagagaattcgaatacacgataaccnnngatcgacatg

SEQ ID NO: 618 - DNA, 46 bp, Artificial Sequence
  Synthesized adaptor oligonucleotide
  misc_feature (34)..(36): n is a, c, g, or t
tgcaggaccagagaattcgaatacattatgacannngatcgacatg

SEQ ID NO: 619 - DNA, 46 bp, Artificial Sequence
  Synthesized adaptor oligonucleotide
  misc_feature (34)..(36): n is a, c, g, or t
tgcaggaccagagaattcgaatacaaccttcacnnngatcgacatg

SEQ ID NO: 620 - DNA, 46 bp, Artificial Sequence
  Synthesized adaptor oligonucleotide
  misc_feature (34)..(36): n is a, c, g, or t
tgcaggaccagagaattcgaatacatcttctccnnngatcgacatg

SEQ ID NO: 621 - DNA, 46 bp, Artificial Sequence
  Synthesized adaptor oligonucleotide
  misc_feature (34)..(36): n is a, c, g, or t
tgcaggaccagagaattcgaatacaccccagctnnngatcgacatg

SEQ ID NO: 622 - DNA, 46 bp, Artificial Sequence
  Synthesized adaptor oligonucleotide
  misc_feature (34)..(36): n is a, c, g, or t
tgcaggaccagagaattcgaatacactagtgtgnnngatcgacatg

SEQ ID NO: 623 - DNA, 46 bp, Artificial Sequence
  Synthesized adaptor oligonucleotide
  misc_feature (34)..(36): n is a, c, g, or t
tgcaggaccagagaattcgaatacagttctaaannngatcgacatg

SEQ ID NO: 624 - DNA, 46 bp, Artificial Sequence
  Synthesized adaptor oligonucleotide
  misc_feature (34)..(36): n is a, c, g, or t
tgcaggaccagagaattcgaatacagcgttttcnnngatcgacatg

SEQ ID NO: 625 - DNA, 46 bp, Artificial Sequence
  Synthesized adaptor oligonucleotide
  misc_feature (34)..(36): n is a, c, g, or t
tgcaggaccagagaattcgaatacagtctgcccnnngatcgacatg

SEQ ID NO: 626 - DNA, 46 bp, Artificial Sequence
  Synthesized adaptor oligonucleotide
  misc_feature (34)..(36): n is a, c, g, or t
tgcaggaccagagaattcgaatacaacagaaatnnngatcgacatg

SEQ ID NO: 627 - DNA, 46 bp, Artificial Sequence
  Synthesized adaptor oligonucleotide
  misc_feature (34)..(36): n is a, c, g, or t
tgcaggaccagagaattcgaatacattgctattnnngatcgacatg

SEQ ID NO: 628 - DNA, 46 bp, Artificial Sequence
  Synthesized adaptor oligonucleotide
  misc_feature (34)..(36): n is a, c, g, or t
tgcaggaccagagaattcgaatacaccctgtgcnnngatcgacatg

SEQ ID NO: 629 - DNA, 46 bp, Artificial Sequence
  Synthesized adaptor oligonucleotide
  misc_feature (34)..(36): n is a, c, g, or t
tgcaggaccagagaattcgaatacagcagtccgnnngatcgacatg

SEQ ID NO: 630 - DNA, 46 bp, Artificial Sequence
  Synthesized adaptor oligonucleotide
  misc_feature (34)..(36): n is a, c, g, or t
tgcaggaccagagaattcgaatacagtaacccannngatcgacatg

SEQ ID NO: 631 - DNA, 46 bp, Artificial Sequence
  Synthesized adaptor oligonucleotide
  misc_feature (34)..(36): n is a, c, g, or t
tgcaggaccagagaattcgaatacaacattgtannngatcgacatg

SEQ ID NO: 632 - DNA, 46 bp, Artificial Sequence
  Synthesized adaptor oligonucleotide
  misc_feature (34)..(36): n is a, c, g, or t
tgcaggaccagagaattcgaatacaaaaccgtcnnngatcgacatg

SEQ ID NO: 633 - DNA, 46 bp, Artificial Sequence
  Synthesized adaptor oligonucleotide
  misc_feature (34)..(36): n is a, c, g, or t
tgcaggaccagagaattcgaatacaattctgccnnngatcgacatg

SEQ ID NO: 634 - DNA, 46 bp, Artificial Sequence
  Synthesized adaptor oligonucleotide
  misc_feature (34)..(36): n is a, c, g, or t
tgcaggaccagagaattcgaatacatctaggcannngatcgacatg

SEQ ID NO: 635 - DNA, 46 bp, Artificial Sequence
  Synthesized adaptor oligonucleotide
  misc_feature (34)..(36): n is a, c, g, or t
tgcaggaccagagaattcgaatacaggtctacannngatcgacatg

SEQ ID NO: 636 - DNA, 46 bp, Artificial Sequence
  Synthesized adaptor oligonucleotide
  misc_feature (34)..(36): n is a, c, g, or t
tgcaggaccagagaattcgaatacaggtgagcgnnngatcgacatg

SEQ ID NO: 637 - DNA, 46 bp, Artificial Sequence
  Synthesized adaptor oligonucleotide
  misc_feature (34)..(36): n is a, c, g, or t
tgcaggaccagagaattcgaatacatgtctttannngatcgacatg

SEQ ID NO: 638 - DNA, 46 bp, Artificial Sequence
  Synthesized adaptor oligonucleotide
  misc_feature (34)..(36): n is a, c, g, or t
tgcaggaccagagaattcgaatacatggcttgannngatcgacatg

SEQ ID NO: 639 - DNA, 46 bp, Artificial Sequence
  Synthesized adaptor oligonucleotide
  misc_feature (34)..(36): n is a, c, g, or t
tgcaggaccagagaattcgaatacaattacgcgnnngatcgacatg

SEQ ID NO: 640 - DNA, 46 bp, Artificial Sequence
  Synthesized adaptor oligonucleotide
  misc_feature (34)..(36): n is a, c, g, or t
tgcaggaccagagaattcgaatacatggctcttnnngatcgacatg

SEQ ID NO: 641 - DNA, 46 bp, Artificial Sequence
  Synthesized adaptor oligonucleotide
  misc_feature (34)..(36): n is a, c, g, or t
tgcaggaccagagaattcgaatacacactcactnnngatcgacatg

SEQ ID NO: 642 - DNA, 46 bp, Artificial Sequence
  Synthesized adaptor oligonucleotide
  misc_feature (34)..(36): n is a, c, g, or t
tgcaggaccagagaattcgaatacactgcaggcnnngatcgacatg

SEQ ID NO: 643 - DNA, 46 bp, Artificial Sequence
  Synthesized adaptor oligonucleotide
  misc_feature (34)..(36): n is a, c, g, or t
tgcaggaccagagaattcgaatacacccaatctnnngatcgacatg

SEQ ID NO: 644 - DNA, 46 bp, Artificial Sequence
  Synthesized adaptor oligonucleotide
  misc_feature (34)..(36): n is a, c, g, or t
tgcaggaccagagaattcgaatacaacgtaaccnnngatcgacatg

SEQ ID NO: 645 - DNA, 46 bp, Artificial Sequence
  Synthesized adaptor oligonucleotide
  misc_feature (34)..(36): n is a, c, g, or t
tgcaggaccagagaattcgaatacaaccgtcccnnngatcgacatg

SEQ ID NO: 646 - DNA, 46 bp, Artificial Sequence
  Synthesized adaptor oligonucleotide
  misc_feature (34)..(36): n is a, c, g, or t
tgcaggaccagagaattcgaatacattcgcgaannngatcgacatg

SEQ ID NO: 647 - DNA, 46 bp, Artificial Sequence
  Synthesized adaptor oligonucleotide
  misc_feature (34)..(36): n is a, c, g, or t
tgcaggaccagagaattcgaatacacgcacaatnnngatcgacatg

SEQ ID NO: 648 - DNA, 46 bp, Artificial Sequence
  Synthesized adaptor oligonucleotide
  misc_feature (34)..(36): n is a, c, g, or t
tgcaggaccagagaattcgaatacacaatctccnnngatcgacatg

SEQ ID NO: 649 - DNA, 46 bp, Artificial Sequence
  Synthesized adaptor oligonucleotide
  misc_feature (34)..(36): n is a, c, g, or t
tgcaggaccagagaattcgaatacatcagagtcnnngatcgacatg

SEQ ID NO: 650 - DNA, 46 bp, Artificial Sequence
  Synthesized adaptor oligonucleotide
  misc_feature (34)..(36): n is a, c, g, or t
tgcaggaccagagaattcgaatacaaatcgtgcnnngatcgacatg

SEQ ID NO: 651 - DNA, 46 bp, Artificial Sequence
  Synthesized adaptor oligonucleotide
  misc_feature (34)..(36): n is a, c, g, or t
tgcaggaccagagaattcgaatacactagcatgnnngatcgacatg

SEQ ID NO: 652 - DNA, 46 bp, Artificial Sequence
  Synthesized adaptor oligonucleotide
  misc_feature (34)..(36): n is a, c, g, or t
tgcaggaccagagaattcgaatacagattaactnnngatcgacatg

SEQ ID NO: 653 - DNA, 46 bp, Artificial Sequence
  Synthesized adaptor oligonucleotide
  misc_feature (34)..(36): n is a, c, g, or t
tgcaggaccagagaattcgaatacaggctacgcnnngatcgacatg

SEQ ID NO: 654 - DNA, 46 bp, Artificial Sequence
  Synthesized adaptor oligonucleotide
  misc_feature (34)..(36): n is a, c, g, or t
tgcaggaccagagaattcgaatacaatacgaggnnngatcgacatg

SEQ ID NO: 655 - DNA, 46 bp, Artificial Sequence
  Synthesized adaptor oligonucleotide
  misc_feature (34)..(36): n is a, c, g, or t
tgcaggaccagagaattcgaatacaaaatgtctnnngatcgacatg

SEQ ID NO: 656 - DNA, 46 bp, Artificial Sequence
  Synthesized adaptor oligonucleotide
  misc_feature (34)..(36): n is a, c, g, or t
tgcaggaccagagaattcgaatacagcgcatcgnnngatcgacatg

SEQ ID NO: 657 - DNA, 46 bp, Artificial Sequence
  Synthesized adaptor oligonucleotide
  misc_feature (34)..(36): n is a, c, g, or t
tgcaggaccagagaattcgaatacactcccgtgnnngatcgacatg

SEQ ID NO: 658 - DNA, 46 bp, Artificial Sequence
  Synthesized adaptor oligonucleotide
  misc_feature (34)..(36): n is a, c, g, or t
tgcaggaccagagaattcgaatacagataaggcnnngatcgacatg

SEQ ID NO: 659 - DNA, 46 bp, Artificial Sequence
  Synthesized adaptor oligonucleotide
  misc_feature (34)..(36): n is a, c, g, or t
tgcaggaccagagaattcgaatacagcacatcannngatcgacatg

SEQ ID NO: 660 - DNA, 46 bp, Artificial Sequence
  Synthesized adaptor oligonucleotide
  misc_feature (34)..(36): n is a, c, g, or t
tgcaggaccagagaattcgaatacatcctatgcnnngatcgacatg

SEQ ID NO: 661 - DNA, 46 bp, Artificial Sequence
  Synthesized adaptor oligonucleotide
  misc_feature (34)..(36): n is a, c, g, or t
tgcaggaccagagaattcgaatacacgcatcccnnngatcgacatg

SEQ ID NO: 662 - DNA, 46 bp, Artificial Sequence
  Synthesized adaptor oligonucleotide
  misc_feature (34)..(36): n is a, c, g, or t
tgcaggaccagagaattcgaatacaaccggtcgnnngatcgacatg

SEQ ID NO: 663 - DNA, 46 bp, Artificial Sequence
  Synthesized adaptor oligonucleotide
  misc_feature (34)..(36): n is a, c, g, or t
tgcaggaccagagaattcgaatacacacgatgtnnngatcgacatg

SEQ ID NO: 664 - DNA, 46 bp, Artificial Sequence
  Synthesized adaptor oligonucleotide
  misc_feature (34)..(36): n is a, c, g, or t
tgcaggaccagagaattcgaatacaaactcgcannngatcgacatg

SEQ ID NO: 665 - DNA, 46 bp, Artificial Sequence
  Synthesized adaptor oligonucleotide
  misc_feature (34)..(36): n is a, c, g, or t
tgcaggaccagagaattcgaatacaccccttccnnngatcgacatg

SEQ ID NO: 666 - DNA, 46 bp, Artificial Sequence
  Synthesized adaptor oligonucleotide
  misc_feature (34)..(36): n is a, c, g, or t
tgcaggaccagagaattcgaatacatcttcgtgnnngatcgacatg

SEQ ID NO: 667 - DNA, 46 bp, Artificial Sequence
  Synthesized adaptor oligonucleotide
  misc_feature (34)..(36): n is a, c, g, or t
tgcaggaccagagaattcgaatacatatttaaannngatcgacatg

SEQ ID NO: 668 - DNA, 46 bp, Artificial Sequence
  Synthesized adaptor oligonucleotide
  misc_feature (34)..(36): n is a, c, g, or t
tgcaggaccagagaattcgaatacattaatgcannngatcgacatg

SEQ ID NO: 669 - DNA, 46 bp, Artificial Sequence
  Synthesized adaptor oligonucleotide
  misc_feature (34)..(36): n is a, c, g, or t
tgcaggaccagagaattcgaatacactttggtcnnntgcatcaggt

SEQ ID NO: 670 - DNA, 46 bp, Artificial Sequence
  Synthesized adaptor oligonucleotide
  misc_feature (34)..(36): n is a, c, g, or t
tgcaggaccagagaattcgaatacatacgaaggnnntgcatcaggt

SEQ ID NO: 671 - DNA, 46 bp, Artificial Sequence
  Synthesized adaptor oligonucleotide
  misc_feature (34)..(36): n is a, c, g, or t
tgcaggaccagagaattcgaatacaagtcactgnnntgcatcaggt

SEQ ID NO: 672 - DNA, 46 bp, Artificial Sequence
  Synthesized adaptor oligonucleotide
  misc_feature (34)..(36): n is a, c, g, or t
tgcaggaccagagaattcgaatacagtttatctnnntgcatcaggt

SEQ ID NO: 673 - DNA, 46 bp, Artificial Sequence
  Synthesized adaptor oligonucleotide
  misc_feature (34)..(36): n is a, c, g, or t
tgcaggaccagagaattcgaatacatttcgaaannntgcatcaggt

SEQ ID NO: 674 - DNA, 46 bp, Artificial Sequence
  Synthesized adaptor oligonucleotide
  misc_feature (34)..(36): n is a, c, g, or t
tgcaggaccagagaattcgaatacacagatcacnnntgcatcaggt

SEQ ID NO: 675 - DNA, 46 bp, Artificial Sequence
  Synthesized adaptor oligonucleotide
  misc_feature (34)..(36): n is a, c, g, or t
tgcaggaccagagaattcgaatacattggaaggnnntgcatcaggt

SEQ ID NO: 676 - DNA, 46 bp, Artificial Sequence
  Synthesized adaptor oligonucleotide
  misc_feature (34)..(36): n is a, c, g, or t
tgcaggaccagagaattcgaatacagtgcggctnnntgcatcaggt

SEQ ID NO: 677 - DNA, 46 bp, Artificial Sequence
  Synthesized adaptor oligonucleotide
  misc_feature (34)..(36): n is a, c, g, or t
tgcaggaccagagaattcgaatacatgaaggcannntgcatcaggt

SEQ ID NO: 678 - DNA, 46 bp, Artificial Sequence
  Synthesized adaptor oligonucleotide
  misc_feature (34)..(36): n is a, c, g, or t
tgcaggaccagagaattcgaatacaaaaagtacnnntgcatcaggt

SEQ ID NO: 679 - DNA, 46 bp, Artificial Sequence
  Synthesized adaptor oligonucleotide
  misc_feature (34)..(36): n is a, c, g, or t
tgcaggaccagagaattcgaatacagatggaacnnntgcatcaggt

SEQ ID NO: 680 - DNA, 46 bp, Artificial Sequence
  Synthesized adaptor oligonucleotide
  misc_feature (34)..(36): n is a, c, g, or t
tgcaggaccagagaattcgaatacagcctcgagnnntgcatcaggt

SEQ ID NO: 681 - DNA, 46 bp, Artificial Sequence
  Synthesized adaptor oligonucleotide
  misc_feature (34)..(36): n is a, c, g, or t
tgcaggaccagagaattcgaatacaaaataaatnnntgcatcaggt

SEQ ID NO: 682 - DNA, 46 bp, Artificial Sequence
  Synthesized adaptor oligonucleotide
  misc_feature (34)..(36): n is a, c, g, or t
tgcaggaccagagaattcgaatacattccccccnnntgcatcaggt

SEQ ID NO: 683 - DNA, 46 bp, Artificial Sequence
  Synthesized adaptor oligonucleotide
  misc_feature (34)..(36): n is a, c, g, or t
tgcaggaccagagaattcgaatacattcttcttnnntgcatcaggt

SEQ ID NO: 684 - DNA, 46 bp, Artificial Sequence
  Synthesized adaptor oligonucleotide
  misc_feature (34)..(36): n is a, c, g, or t
tgcaggaccagagaattcgaatacattgtggcannntgcatcaggt

SEQ ID NO: 685 - DNA, 46 bp, Artificial Sequence
  Synthesized adaptor oligonucleotide
  misc_feature (34)..(36): n is a, c, g, or t
tgcaggaccagagaattcgaatacatcccatgtnnntgcatcaggt

SEQ ID NO: 686 - DNA, 46 bp, Artificial Sequence
  Synthesized adaptor oligonucleotide
  misc_feature (34)..(36): n is a, c, g, or t
tgcaggaccagagaattcgaatacagtgttgacnnntgcatcaggt

SEQ ID NO: 687 - DNA, 46 bp, Artificial Sequence
  Synthesized adaptor oligonucleotide
  misc_feature (34)..(36): n is a, c, g, or t
tgcaggaccagagaattcgaatacatcgcctatnnntgcatcaggt

SEQ ID NO: 688 - DNA, 46 bp, Artificial Sequence
  Synthesized adaptor oligonucleotide
  misc_feature (34)..(36): n is a, c, g, or t
tgcaggaccagagaattcgaatacacgctgacgnnntgcatcaggt

SEQ ID NO: 689 - DNA, 46 bp, Artificial Sequence
  Synthesized adaptor oligonucleotide
  misc_feature (34)..(36): n is a, c, g, or t
tgcaggaccagagaattcgaatacatggtggttnnntgcatcaggt

SEQ ID NO: 690 - DNA, 46 bp, Artificial Sequence
  Synthesized adaptor oligonucleotide
  misc_feature (34)..(36): n is a, c, g, or t
tgcaggaccagagaattcgaatacactatcttannntgcatcaggt

SEQ ID NO: 691 - DNA, 46 bp, Artificial Sequence
  Synthesized adaptor oligonucleotide
  misc_feature (34)..(36): n is a, c, g, or t
tgcaggaccagagaattcgaatacaataacctannntgcatcaggt

SEQ ID NO: 692 - DNA, 46 bp, Artificial Sequence
  Synthesized adaptor oligonucleotide
  misc_feature (34)..(36): n is a, c, g, or t
tgcaggaccagagaattcgaatacaagagtgtgnnntgcatcaggt

SEQ ID NO: 693 - DNA, 46 bp, Artificial Sequence
  Synthesized adaptor oligonucleotide
  misc_feature (34)..(36): n is a, c, g, or t
tgcaggaccagagaattcgaatacaaatggcgannntgcatcaggt

SEQ ID NO: 694 - DNA, 46 bp, Artificial Sequence
  Synthesized adaptor oligonucleotide
  misc_feature (34)..(36): n is a, c, g, or t
tgcaggaccagagaattcgaatacagtctcttgnnntgcatcaggt

SEQ ID NO: 695 - DNA, 46 bp, Artificial Sequence
  Synthesized adaptor oligonucleotide
  misc_feature (34)..(36): n is a, c, g, or t
tgcaggaccagagaattcgaatacatgcccccannntgcatcaggt

SEQ ID NO: 696 - DNA, 46 bp, Artificial Sequence
  Synthesized adaptor oligonucleotide
  misc_feature (34)..(36): n is a, c, g, or t
tgcaggaccagagaattcgaatacacgagctcgnnntgcatcaggt

SEQ ID NO: 697 - DNA, 46 bp, Artificial Sequence
  Synthesized adaptor oligonucleotide
  misc_feature (34)..(36): n is a, c, g, or t
tgcaggaccagagaattcgaatacaactgaaccnnntgcatcaggt

SEQ ID NO: 698 - DNA, 46 bp, Artificial Sequence
  Synthesized adaptor oligonucleotide
  misc_feature (34)..(36): n is a, c, g, or t
tgcaggaccagagaattcgaatacactcgtatcnnntgcatcaggt

SEQ ID NO: 699 - DNA, 46 bp, Artificial Sequence
  Synthesized adaptor oligonucleotide
  misc_feature (34)..(36): n is a, c, g, or t
tgcaggaccagagaattcgaatacacacttccannntgcatcaggt

SEQ ID NO: 700 - DNA, 46 bp, Artificial Sequence
  Synthesized adaptor oligonucleotide
  misc_feature (34)..(36): n is a, c, g, or t
tgcaggaccagagaattcgaatacagatcctgannntgcatcaggt

SEQ ID NO: 701 - DNA, 46 bp, Artificial Sequence
  Synthesized adaptor oligonucleotide
  misc_feature (34)..(36): n is a, c, g, or t
tgcaggaccagagaattcgaatacaagaagtatnnntgcatcaggt

SEQ ID NO: 702 - DNA, 46 bp, Artificial Sequence
  Synthesized adaptor oligonucleotide
  misc_feature (34)..(36): n is a, c, g, or t
tgcaggaccagagaattcgaatacaaacccacannntgcatcaggt

SEQ ID NO: 703 - DNA, 46 bp, Artificial Sequence
  Synthesized adaptor oligonucleotide
  misc_feature (34)..(36): n is a, c, g, or t
tgcaggaccagagaattcgaatacatgccgaatnnntgcatcaggt

SEQ ID NO: 704 - DNA, 46 bp, Artificial Sequence
  Synthesized adaptor oligonucleotide
  misc_feature (34)..(36): n is a, c, g, or t
tgcaggaccagagaattcgaatacaatcagaggnnntgcatcaggt

SEQ ID NO: 705 - DNA, 46 bp, Artificial Sequence
  Synthesized adaptor oligonucleotide
  misc_feature (34)..(36): n is a, c, g, or t
tgcaggaccagagaattcgaatacagtcatatannntgcatcaggt

SEQ ID NO: 706 - DNA, 46 bp, Artificial Sequence
  Synthesized adaptor oligonucleotide
  misc_feature (34)..(36): n is a, c, g, or t
tgcaggaccagagaattcgaatacaacccacccnnntgcatcaggt

SEQ ID NO: 707 - DNA, 46 bp, Artificial Sequence
  Synthesized adaptor oligonucleotide
  misc_feature (34)..(36): n is a, c, g, or t
tgcaggaccagagaattcgaatacacccacaggnnntgcatcaggt

SEQ ID NO: 708 - DNA, 46 bp, Artificial Sequence
  Synthesized adaptor oligonucleotide
  misc_feature (34)..(36): n is a, c, g, or t
tgcaggaccagagaattcgaatacatgctgaacnnntgcatcaggt

SEQ ID NO: 709 - DNA, 46 bp, Artificial Sequence
  Synthesized adaptor oligonucleotide
  misc_feature (34)..(36): n is a, c, g, or t
tgcaggaccagagaattcgaatacagcagcattnnntgcatcaggt

SEQ ID NO: 710 - DNA, 46 bp, Artificial Sequence
  Synthesized adaptor oligonucleotide
  misc_feature (34)..(36): n is a, c, g, or t
tgcaggaccagagaattcgaatacaggcgatggnnntgcatcaggt

SEQ ID NO: 711 - DNA, 46 bp, Artificial Sequence
  Synthesized adaptor oligonucleotide
  misc_feature (34)..(36): n is a, c, g, or t
tgcaggaccagagaattcgaatacattcgatggnnntgcatcaggt

SEQ ID NO: 712 - DNA, 46 bp, Artificial Sequence
  Synthesized adaptor oligonucleotide
  misc_feature (34)..(36): n is a, c, g, or t
tgcaggaccagagaattcgaatacatggaggcgnnntgcatcaggt

SEQ ID NO: 713 - DNA, 46 bp, Artificial Sequence
  Synthesized adaptor oligonucleotide
  misc_feature (34)..(36): n is a, c, g, or t
tgcaggaccagagaattcgaatacagtattacannntgcatcaggt

SEQ ID NO: 714 - DNA, 46 bp, Artificial Sequence
  Synthesized adaptor oligonucleotide
  misc_feature (34)..(36): n is a, c, g, or t
tgcaggaccagagaattcgaatacacgacaatcnnntgcatcaggt

SEQ ID NO: 715 - DNA, 46 bp, Artificial Sequence
  Synthesized adaptor oligonucleotide
  misc_feature (34)..(36): n is a, c, g, or t
tgcaggaccagagaattcgaatacagtggccacnnntgcatcaggt

SEQ ID NO: 716 - DNA, 46 bp, Artificial Sequence
  Synthesized adaptor oligonucleotide
  misc_feature (34)..(36): n is a, c, g, or t
tgcaggaccagagaattcgaatacatacgcgcgnnntgcatcaggt

SEQ ID NO: 717 - DNA, 46 bp, Artificial Sequence
  Synthesized adaptor oligonucleotide
  misc_feature (34)..(36): n is a, c, g, or t
tgcaggaccagagaattcgaatacacgaagacannntgcatcaggt

SEQ ID NO: 718 - DNA, 46 bp, Artificial Sequence
  Synthesized adaptor oligonucleotide
  misc_feature (34)..(36): n is a, c, g, or t
tgcaggaccagagaattcgaatacaccaatgacnnntgcatcaggt

SEQ ID NO: 719 - DNA, 46 bp, Artificial Sequence
  Synthesized adaptor oligonucleotide
  misc_feature (34)..(36): n is a, c, g, or t
tgcaggaccagagaattcgaatacaagccttctnnntgcatcaggt

SEQ ID NO: 720 - DNA, 46 bp, Artificial Sequence
  Synthesized adaptor oligonucleotide
  misc_feature (34)..(36): n is a, c, g, or t
tgcaggaccagagaattcgaatacatatcacccnnntgcatcaggt

SEQ ID NO: 721 - DNA, 46 bp, Artificial Sequence
  Synthesized adaptor oligonucleotide
  misc_feature (34)..(36): n is a, c, g, or t
tgcaggaccagagaattcgaatacaccttatgcnnntgcatcaggt

SEQ ID NO: 722 - DNA, 46 bp, Artificial Sequence
  Synthesized adaptor oligonucleotide
  misc_feature (34)..(36): n is a, c, g, or t
tgcaggaccagagaattcgaatacattaatgacnnntgcatcaggt

SEQ ID NO: 723 - DNA, 46 bp, Artificial Sequence
  Synthesized adaptor oligonucleotide
  misc_feature (34)..(36): n is a, c, g, or t
tgcaggaccagagaattcgaatacactaccttgnnntgcatcaggt

SEQ ID NO: 724 - DNA, 46 bp, Artificial Sequence
  Synthesized adaptor oligonucleotide
  misc_feature (34)..(36): n is a, c, g, or t
tgcaggaccagagaattcgaatacaaggatctcnnntgcatcaggt

SEQ ID NO: 725 - DNA, 46 bp, Artificial Sequence
  Synthesized adaptor oligonucleotide
  misc_feature (34)..(36): n is a, c, g, or t
tgcaggaccagagaattcgaatacaaagatcaannntgcatcaggt

SEQ ID NO: 726 - DNA, 46 bp, Artificial Sequence
  Synthesized adaptor oligonucleotide
  misc_feature (34)..(36): n is a, c, g, or t
tgcaggaccagagaattcgaatacagaatgagcnnntgcatcaggt

SEQ ID NO: 727 - DNA, 46 bp, Artificial Sequence
  Synthesized adaptor oligonucleotide
  misc_feature (34)..(36): n is a, c, g, or t
tgcaggaccagagaattcgaatacaactagattnnntgcatcaggt

SEQ ID NO: 728 - DNA, 46 bp, Artificial Sequence
  Synthesized adaptor oligonucleotide
  misc_feature (34)..(36): n is a, c, g, or t
tgcaggaccagagaattcgaatacattttccggnnntgcatcaggt

SEQ ID NO: 729 - DNA, 46 bp, Artificial Sequence
  Synthesized adaptor oligonucleotide
  misc_feature (34)..(36): n is a, c, g, or t
tgcaggaccagagaattcgaatacatatgcgcannnacgtatgcca

SEQ ID NO: 730 - DNA, 46 bp, Artificial Sequence
  Synthesized adaptor oligonucleotide
  misc_feature (34)..(36): n is a, c, g, or t
tgcaggaccagagaattcgaatacagttcacctnnnacgtatgcca

SEQ ID NO: 731 - DNA, 46 bp, Artificial Sequence
  Synthesized adaptor oligonucleotide
  misc_feature (34)..(36): n is a, c, g, or t
tgcaggaccagagaattcgaatacatcctacacnnnacgtatgcca

SEQ ID NO: 732 - DNA, 46 bp, Artificial Sequence
  Synthesized adaptor oligonucleotide
  misc_feature (34)..(36): n is a, c, g, or t
tgcaggaccagagaattcgaatacactactctgnnnacgtatgcca

SEQ ID NO: 733 - DNA, 46 bp, Artificial Sequence
  Synthesized adaptor oligonucleotide
  misc_feature (34)..(36): n is a, c, g, or t
tgcaggaccagagaattcgaatacaccttccccnnnacgtatgcca

SEQ ID NO: 734 - DNA, 46 bp, Artificial Sequence
  Synthesized adaptor oligonucleotide
  misc_feature (34)..(36): n is a, c, g, or t
tgcaggaccagagaattcgaatacagaagatcgnnnacgtatgcca

SEQ ID NO: 735 - DNA, 46 bp, Artificial Sequence
  Synthesized adaptor oligonucleotide
  misc_feature (34)..(36): n is a, c, g, or t
tgcaggaccagagaattcgaatacactccgctgnnnacgtatgcca

SEQ ID NO: 736 - DNA, 46 bp, Artificial Sequence
  Synthesized adaptor oligonucleotide
  misc_feature (34)..(36): n is a, c, g, or t
tgcaggaccagagaattcgaatacatatgtcccnnnacgtatgcca

SEQ ID NO: 737 - DNA, 46 bp, Artificial Sequence
  Synthesized adaptor oligonucleotide
  misc_feature (34)..(36): n is a, c, g, or t
tgcaggaccagagaattcgaatacatatttgctnnnacgtatgcca

SEQ ID NO: 738 - DNA, 46 bp, Artificial Sequence
  Synthesized adaptor oligonucleotide
  misc_feature (34)..(36): n is a, c, g, or t
tgcaggaccagagaattcgaatacagtccaggcnnnacgtatgcca

SEQ ID NO: 739 - DNA, 46 bp, Artificial Sequence
  Synthesized adaptor oligonucleotide
  misc_feature (34)..(36): n is a, c, g, or t
tgcaggaccagagaattcgaatacaaagatggcnnnacgtatgcca

SEQ ID NO: 740 - DNA, 46 bp, Artificial Sequence
  Synthesized adaptor oligonucleotide
  misc_feature (34)..(36): n is a, c, g, or t
tgcaggaccagagaattcgaatacagtcccgagnnnacgtatgcca

SEQ ID NO: 741 - DNA, 46 bp, Artificial Sequence
  Synthesized adaptor oligonucleotide
  misc_feature (34)..(36): n is a, c, g, or t
tgcaggaccagagaattcgaatacaaggtttcgnnnacgtatgcca

SEQ ID NO: 742 - DNA, 46 bp, Artificial Sequence
  Synthesized adaptor oligonucleotide
  misc_feature (34)..(36): n is a, c, g, or t
tgcaggaccagagaattcgaatacatgcaaaggnnnacgtatgcca

SEQ ID NO: 743 - DNA, 46 bp, Artificial Sequence
  Synthesized adaptor oligonucleotide
  misc_feature (34)..(36): n is a, c, g, or t
tgcaggaccagagaattcgaatacaaggtgtagnnnacgtatgcca

SEQ ID NO: 744 - DNA, 46 bp, Artificial Sequence
  Synthesized adaptor oligonucleotide
  misc_feature (34)..(36): n is a, c, g, or t
tgcaggaccagagaattcgaatacacacgagttnnnacgtatgcca

SEQ ID NO: 745 - DNA, 46 bp, Artificial Sequence
  Synthesized adaptor oligonucleotide
  misc_feature (34)..(36): n is a, c, g, or t
tgcaggaccagagaattcgaatacacaccgcctnnnacgtatgcca

SEQ ID NO: 746 - DNA, 46 bp, Artificial Sequence
  Synthesized adaptor oligonucleotide
  misc_feature (34)..(36): n is a, c, g, or t
tgcaggaccagagaattcgaatacaaagctaccnnnacgtatgcca

SEQ ID NO: 747 - DNA, 46 bp, Artificial Sequence
  Synthesized adaptor oligonucleotide
  misc_feature (34)..(36): n is a, c, g, or t
tgcaggaccagagaattcgaatacagaaccgaannnacgtatgcca

SEQ ID NO: 748 - DNA, 46 bp, Artificial Sequence
  Synthesized adaptor oligonucleotide
  misc_feature (34)..(36): n is a, c, g, or t
tgcaggaccagagaattcgaatacaagtactgcnnnacgtatgcca

SEQ ID NO: 749 - DNA, 46 bp, Artificial Sequence
  Synthesized adaptor oligonucleotide
  misc_feature (34)..(36): n is a, c, g, or t
tgcaggaccagagaattcgaatacaaacaattcnnnacgtatgcca

SEQ ID NO: 750 - DNA, 46 bp, Artificial Sequence
  Synthesized adaptor oligonucleotide
  misc_feature (34)..(36): n is a, c, g, or t
tgcaggaccagagaattcgaatacagtattaacnnnacgtatgcca

SEQ ID NO: 751 - DNA, 46 bp, Artificial Sequence
  Synthesized adaptor oligonucleotide
  misc_feature (34)..(36): n is a, c, g, or t
tgcaggaccagagaattcgaatacatgattatgnnnacgtatgcca

SEQ ID NO: 752 - DNA, 46 bp, Artificial Sequence
  Synthesized adaptor oligonucleotide
  misc_feature (34)..(36): n is a, c, g, or t
tgcaggaccagagaattcgaatacagcaaacctnnnacgtatgcca

SEQ ID NO: 753 - DNA, 46 bp, Artificial Sequence
  Synthesized adaptor oligonucleotide
  misc_feature (34)..(36): n is a, c, g, or t
tgcaggaccagagaattcgaatacagaatcttannnacgtatgcca

SEQ ID NO: 754 - DNA, 46 bp, Artificial Sequence
  Synthesized adaptor oligonucleotide
  misc_feature (34)..(36): n is a, c, g, or t
tgcaggaccagagaattcgaatacagaggacgcnnnacgtatgcca

SEQ ID NO: 755 - DNA, 46 bp, Artificial Sequence
  Synthesized adaptor oligonucleotide
  misc_feature (34)..(36): n is a, c, g, or t
tgcaggaccagagaattcgaatacaagccaaagnnnacgtatgcca

SEQ ID NO: 756 - DNA, 46 bp, Artificial Sequence
  Synthesized adaptor oligonucleotide
  misc_feature (34)..(36): n is a, c, g, or t
tgcaggaccagagaattcgaatacaggacgctcnnnacgtatgcca

SEQ ID NO: 757 - DNA, 46 bp, Artificial Sequence
  Synthesized adaptor oligonucleotide
  misc_feature (34)..(36): n is a, c, g, or t
tgcaggaccagagaattcgaatacagctgccctnnnacgtatgcca

SEQ ID NO: 758 - DNA, 46 bp, Artificial Sequence
  Synthesized adaptor oligonucleotide
  misc_feature (34)..(36): n is a, c, g, or t
tgcaggaccagagaattcgaatacacccttttcnnnacgtatgcca

SEQ ID NO: 759 - DNA, 46 bp, Artificial Sequence
  Synthesized adaptor oligonucleotide
  misc_feature (34)..(36): n is a, c, g, or t
tgcaggaccagagaattcgaatacatcgcagatnnnacgtatgcca

SEQ ID NO: 760 - DNA, 46 bp, Artificial Sequence
  Synthesized adaptor oligonucleotide
  misc_feature (34)..(36): n is a, c, g, or t
tgcaggaccagagaattcgaatacaatcgcatgnnnacgtatgcca

SEQ ID NO: 761 - DNA, 46 bp, Artificial Sequence
  Synthesized adaptor oligonucleotide
  misc_feature (34)..(36): n is a, c, g, or t
tgcaggaccagagaattcgaatacaagatggcannnacgtatgcca

SEQ ID NO: 762 - DNA, 46 bp, Artificial Sequence
  Synthesized adaptor oligonucleotide
  misc_feature (34)..(36): n is a, c, g, or t
tgcaggaccagagaattcgaatacatcatcgctnnnacgtatgcca

SEQ ID NO: 763 - DNA, 46 bp, Artificial Sequence
  Synthesized adaptor oligonucleotide
  misc_feature (34)..(36): n is a, c, g, or t
tgcaggaccagagaattcgaatacacgtgttctnnnacgtatgcca

SEQ ID NO: 764 - DNA, 46 bp, Artificial Sequence
  Synthesized adaptor oligonucleotide
  misc_feature (34)..(36): n is a, c, g, or t
tgcaggaccagagaattcgaatacaggttattannnacgtatgcca

SEQ ID NO: 765 - DNA, 46 bp, Artificial Sequence
  Synthesized adaptor oligonucleotide
  misc_feature (34)..(36): n is a, c, g, or t
tgcaggaccagagaattcgaatacaagagttaannnacgtatgcca

SEQ ID NO: 766 - DNA, 46 bp, Artificial Sequence
  Synthesized adaptor oligonucleotide
  misc_feature (34)..(36): n is a, c, g, or t
tgcaggaccagagaattcgaatacatgaaattcnnnacgtatgcca

SEQ ID NO: 767 - DNA, 46 bp, Artificial Sequence
  Synthesized adaptor oligonucleotide
  misc_feature (34)..(36): n is a, c, g, or t
tgcaggaccagagaattcgaatacacttacctgnnnacgtatgcca

SEQ ID NO: 768 - DNA, 46 bp, Artificial Sequence
  Synthesized adaptor oligonucleotide
  misc_feature (34)..(36): n is a, c, g, or t
tgcaggaccagagaattcgaatacaaactcgtgnnnacgtatgcca

SEQ ID NO: 769 - DNA, 46 bp, Artificial Sequence
  Synthesized adaptor oligonucleotide
  misc_feature (34)..(36): n is a, c, g, or t
tgcaggaccagagaattcgaatacaggacacggnnnacgtatgcca

SEQ ID NO: 770 - DNA, 46 bp, Artificial Sequence
  Synthesized adaptor oligonucleotide
  misc_feature (34)..(36): n is a, c, g, or t
tgcaggaccagagaattcgaatacatctcgcgcnnnacgtatgcca

SEQ ID NO: 771 - DNA, 46 bp, Artificial Sequence
  Synthesized adaptor oligonucleotide
  misc_feature (34)..(36): n is a, c, g, or t
tgcaggaccagagaattcgaatacacttccagtnnnacgtatgcca

SEQ ID NO: 772 - DNA, 46 bp, Artificial Sequence
  Synthesized adaptor oligonucleotide
  misc_feature (34)..(36): n is a, c, g, or t
tgcaggaccagagaattcgaatacaatagttacnnnacgtatgcca

SEQ ID NO: 773 - DNA, 46 bp, Artificial Sequence
  Synthesized adaptor oligonucleotide
  misc_feature (34)..(36): n is a, c, g, or t
tgcaggaccagagaattcgaatacacgacttgannnacgtatgcca

SEQ ID NO: 774 - DNA, 46 bp, Artificial Sequence
  Synthesized adaptor oligonucleotide
  misc_feature (34)..(36): n is a, c, g, or t
tgcaggaccagagaattcgaatacatgctttatnnnacgtatgcca

SEQ ID NO: 775 - DNA, 46 bp, Artificial Sequence
  Synthesized adaptor oligonucleotide
  misc_feature (34)..(36): n is a, c, g, or t
tgcaggaccagagaattcgaatacagccactttnnnacgtatgcca

SEQ ID NO: 776 - DNA, 46 bp, Artificial Sequence
  Synthesized adaptor oligonucleotide
  misc_feature (34)..(36): n is a, c, g, or t
tgcaggaccagagaattcgaatacatatcggacnnnacgtatgcca

SEQ ID NO: 777 - DNA, 46 bp, Artificial Sequence
  Synthesized adaptor oligonucleotide
  misc_feature (34)..(36): n is a, c, g, or t
tgcaggaccagagaattcgaatacaattccattnnnacgtatgcca

SEQ ID NO: 778 - DNA, 46 bp, Artificial Sequence
  Synthesized adaptor oligonucleotide
  misc_feature (34)..(36): n is a, c, g, or t
tgcaggaccagagaattcgaatacaaatgctgcnnnacgtatgcca

SEQ ID NO: 779 - DNA, 46 bp, Artificial Sequence
  Synthesized adaptor oligonucleotide
  misc_feature (34)..(36): n is a, c, g, or t
tgcaggaccagagaattcgaatacaacgcgattnnnacgtatgcca

SEQ ID NO: 780 - DNA, 46 bp, Artificial Sequence
  Synthesized adaptor oligonucleotide
  misc_feature (34)..(36): n is a, c, g, or t
tgcaggaccagagaattcgaatacatagctagcnnnacgtatgcca

SEQ ID NO: 781 - DNA, 46 bp, Artificial Sequence
  Synthesized adaptor oligonucleotide
  misc_feature (34)..(36): n is a, c, g, or t
tgcaggaccagagaattcgaatacagcaacgttnnnacgtatgcca

SEQ ID NO: 782 - DNA, 46 bp, Artificial Sequence
  Synthesized adaptor oligonucleotide
  misc_feature (34)..(36): n is a, c, g, or t
tgcaggaccagagaattcgaatacacgtcctatnnnacgtatgcca

SEQ ID NO: 783 - DNA, 46 bp, Artificial Sequence
  Synthesized adaptor oligonucleotide
  misc_feature (34)..(36): n is a, c, g, or t
tgcaggaccagagaattcgaatacagccacacgnnnacgtatgcca

SEQ ID NO: 784 - DNA, 46 bp, Artificial Sequence
  Synthesized adaptor oligonucleotide
  misc_feature (34)..(36): n is a, c, g, or t
tgcaggaccagagaattcgaatacaggcttcccnnnacgtatgcca

SEQ ID NO: 785 - DNA, 46 bp, Artificial Sequence
  Synthesized adaptor oligonucleotide
  misc_feature (34)..(36): n is a, c, g, or t
tgcaggaccagagaattcgaatacagttgacacnnnacgtatgcca

SEQ ID NO: 786 - DNA, 46 bp, Artificial Sequence
  Synthesized adaptor oligonucleotide
  misc_feature (34)..(36): n is a, c, g, or t
tgcaggaccagagaattcgaatacagcatcttcnnnacgtatgcca

SEQ ID NO: 787 - DNA, 46 bp, Artificial Sequence
  Synthesized adaptor oligonucleotide
  misc_feature (34)..(36): n is a, c, g, or t
tgcaggaccagagaattcgaatacaacaattgtnnnacgtatgcca

SEQ ID NO: 788 - DNA, 46 bp, Artificial Sequence
  Synthesized adaptor oligonucleotide
  misc_feature (34)..(36): n is a, c, g, or t
tgcaggaccagagaattcgaatacagatcccccnnnacgtatgcca

SEQ ID NO: 789 - DNA, 46 bp, Artificial Sequence
  Synthesized adaptor oligonucleotide
  misc_feature (34)..(36): n is a, c, g, or t
tgcaggaccagagaattcgaatacagcccagtgnnnctagcgttac

SEQ ID NO: 790 - DNA, 46 bp, Artificial Sequence
  Synthesized adaptor oligonucleotide
  misc_feature (34)..(36): n is a, c, g, or t
tgcaggaccagagaattcgaatacagcggtgctnnnctagcgttac

SEQ ID NO: 791 - DNA, 46 bp, Artificial Sequence
  Synthesized adaptor oligonucleotide
  misc_feature (34)..(36): n is a, c, g, or t
tgcaggaccagagaattcgaatacatacgtgcannnctagcgttac

SEQ ID NO: 792 - DNA, 46 bp, Artificial Sequence
  Synthesized adaptor oligonucleotide
  misc_feature (34)..(36): n is a, c, g, or t
tgcaggaccagagaattcgaatacacacccaccnnnctagcgttac

SEQ ID NO: 793 - DNA, 46 bp, Artificial Sequence
  Synthesized adaptor oligonucleotide
  misc_feature (34)..(36): n is a, c, g, or t
tgcaggaccagagaattcgaatacacacagaagnnnctagcgttac

SEQ ID NO: 794 - DNA, 46 bp, Artificial Sequence
  Synthesized adaptor oligonucleotide
  misc_feature (34)..(36): n is a, c, g, or t
tgcaggaccagagaattcgaatacacgctaacannnctagcgttac

SEQ ID NO: 795 - DNA, 46 bp, Artificial Sequence
  Synthesized adaptor oligonucleotide
  misc_feature (34)..(36): n is a, c, g, or t
tgcaggaccagagaattcgaatacagacctatgnnnctagcgttac

SEQ ID NO: 796 - DNA, 46 bp, Artificial Sequence
  Synthesized adaptor oligonucleotide
  misc_feature (34)..(36): n is a, c, g, or t
tgcaggaccagagaattcgaatacaaaaaggaannnctagcgttac

SEQ ID NO: 797 - DNA, 46 bp, Artificial Sequence
  Synthesized adaptor oligonucleotide
  misc_feature (34)..(36): n is a, c, g, or t
tgcaggaccagagaattcgaatacaacagaggtnnnctagcgttac

SEQ ID NO: 798 - DNA, 46 bp, Artificial Sequence
  Synthesized adaptor oligonucleotide
  misc_feature (34)..(36): n is a, c, g, or t
tgcaggaccagagaattcgaatacacgtagcatnnnctagcgttac

SEQ ID NO: 799 - DNA, 46 bp, Artificial Sequence
  Synthesized adaptor oligonucleotide
  misc_feature (34)..(36): n is a, c, g, or t
tgcaggaccagagaattcgaatacatccccagcnnnctagcgttac

SEQ ID NO: 800 - DNA, 46 bp, Artificial Sequence
  Synthesized adaptor oligonucleotide
  misc_feature (34)..(36): n is a, c, g, or t
tgcaggaccagagaattcgaatacagtacctgannnctagcgttac

SEQ ID NO: 801 - DNA, 46 bp, Artificial Sequence
  Synthesized adaptor oligonucleotide
  misc_feature (34)..(36): n is a, c, g, or t
tgcaggaccagagaattcgaatacaagagaggannnctagcgttac

SEQ ID NO: 802 - DNA, 46 bp, Artificial Sequence
  Synthesized adaptor oligonucleotide
  misc_feature (34)..(36): n is a, c, g, or t
tgcaggaccagagaattcgaatacagtaactcgnnnctagcgttac

SEQ ID NO: 803 - DNA, 46 bp, Artificial Sequence
  Synthesized adaptor oligonucleotide
  misc_feature (34)..(36): n is a, c, g, or t
tgcaggaccagagaattcgaatacaggtacatcnnnctagcgttac

SEQ ID NO: 804 - DNA, 46 bp, Artificial Sequence
  Synthesized adaptor oligonucleotide
  misc_feature (34)..(36): n is a, c, g, or t
tgcaggaccagagaattcgaatacagttaaccgnnnctagcgttac

SEQ ID NO: 805 - DNA, 46 bp, Artificial Sequence
  Synthesized adaptor oligonucleotide
  misc_feature (34)..(36): n is a, c, g, or t
tgcaggaccagagaattcgaatacaaacgagtgnnnctagcgttac

SEQ ID NO: 806 - DNA, 46 bp, Artificial Sequence
  Synthesized adaptor oligonucleotide
  misc_feature (34)..(36): n is a, c, g, or t
tgcaggaccagagaattcgaatacatctcactgnnnctagcgttac

SEQ ID NO: 807 - DNA, 46 bp, Artificial Sequence
  Synthesized adaptor oligonucleotide
  misc_feature (34)..(36): n is a, c, g, or t
tgcaggaccagagaattcgaatacatacgagctnnnctagcgttac

SEQ ID NO: 808 - DNA, 46 bp, Artificial Sequence
  Synthesized adaptor oligonucleotide
  misc_feature (34)..(36): n is a, c, g, or t
tgcaggaccagagaattcgaatacacagataccnnnctagcgttac

SEQ ID NO: 809 - DNA, 46 bp, Artificial Sequence
  Synthesized adaptor oligonucleotide
  misc_feature (34)..(36): n is a, c, g, or t
tgcaggaccagagaattcgaatacatacatttcnnnctagcgttac

SEQ ID NO: 810 - DNA, 46 bp, Artificial Sequence
  Synthesized adaptor oligonucleotide
  misc_feature (34)..(36): n is a, c, g, or t
tgcaggaccagagaattcgaatacagtgtaaggnnnctagcgttac

SEQ ID NO: 811 - DNA, 46 bp, Artificial Sequence
  Synthesized adaptor oligonucleotide
  misc_feature (34)..(36): n is a, c, g, or t
tgcaggaccagagaattcgaatacaggttgaagnnnctagcgttac

SEQ ID NO: 812 - DNA, 46 bp, Artificial Sequence
  Synthesized adaptor oligonucleotide
  misc_feature (34)..(36): n is a, c, g, or t
tgcaggaccagagaattcgaatacacgtccctgnnnctagcgttac

SEQ ID NO: 813 - DNA, 46 bp, Artificial Sequence
  Synthesized adaptor oligonucleotide
  misc_feature (34)..(36): n is a, c, g, or t
tgcaggaccagagaattcgaatacaaatccctcnnnctagcgttac

SEQ ID NO: 814 - DNA, 46 bp, Artificial Sequence
  Synthesized adaptor oligonucleotide
  misc_feature (34)..(36): n is a, c, g, or t
tgcaggaccagagaattcgaatacatgccccacnnnctagcgttac

SEQ ID NO: 815 - DNA, 46 bp, Artificial Sequence
  Synthesized adaptor oligonucleotide
  misc_feature (34)..(36): n is a, c, g, or t
tgcaggaccagagaattcgaatacagtattatgnnnctagcgttac

SEQ ID NO: 816 - DNA, 46 bp, Artificial Sequence
  Synthesized adaptor oligonucleotide
  misc_feature (34)..(36): n is a, c, g, or t
tgcaggaccagagaattcgaatacattgattgannnctagcgttac

SEQ ID NO: 817 - DNA, 46 bp, Artificial Sequence
  Synthesized adaptor oligonucleotide
  misc_feature (34)..(36): n is a, c, g, or t
tgcaggaccagagaattcgaatacatgcgacgcnnnctagcgttac

SEQ ID NO: 818 - DNA, 46 bp, Artificial Sequence
  Synthesized adaptor oligonucleotide
  misc_feature (34)..(36): n is a, c, g, or t
tgcaggaccagagaattcgaatacagtggttcannnctagcgttac

SEQ ID NO: 819 - DNA, 46 bp, Artificial Sequence
  Synthesized adaptor oligonucleotide
  misc_feature (34)..(36): n is a, c, g, or t
tgcaggaccagagaattcgaatacagccggctannnctagcgttac

SEQ ID NO: 820 - DNA, 46 bp, Artificial Sequence
  Synthesized adaptor oligonucleotide
  misc_feature (34)..(36): n is a, c, g, or t
tgcaggaccagagaattcgaatacaccttgcgcnnnctagcgttac

SEQ ID NO: 821 - DNA, 46 bp, Artificial Sequence
  Synthesized adaptor oligonucleotide
  misc_feature (34)..(36): n is a, c, g, or t
tgcaggaccagagaattcgaatacaggtaagtgnnnctagcgttac

SEQ ID NO: 822 - DNA, 46 bp, Artificial Sequence
  Synthesized adaptor oligonucleotide
  misc_feature (34)..(36): n is a, c, g, or t
tgcaggaccagagaattcgaatacagtgtccaannnctagcgttac

SEQ ID NO: 823 - DNA, 46 bp, Artificial Sequence
  Synthesized adaptor oligonucleotide
  misc_feature (34)..(36): n is a, c, g, or t
tgcaggaccagagaattcgaatacatgcactgannnctagcgttac

SEQ ID NO: 824 - DNA, 46 bp, Artificial Sequence
  Synthesized adaptor oligonucleotide
  misc_feature (34)..(36): n is a, c, g, or t
tgcaggaccagagaattcgaatacagaaactttnnnctagcgttac

SEQ ID NO: 825 - DNA, 46 bp, Artificial Sequence
  Synthesized adaptor oligonucleotide
  misc_feature (34)..(36): n is a, c, g, or t
tgcaggaccagagaattcgaatacatgtgtagcnnnctagcgttac

SEQ ID NO: 826 - DNA, 46 bp, Artificial Sequence
  Synthesized adaptor oligonucleotide
  misc_feature (34)..(36): n is a, c, g, or t
tgcaggaccagagaattcgaatacatctacctgnnnctagcgttac

SEQ ID NO: 827 - DNA, 46 bp, Artificial Sequence
  Synthesized adaptor oligonucleotide
  misc_feature (34)..(36): n is a, c, g, or t
tgcaggaccagagaattcgaatacatctcttaannnctagcgttac

SEQ ID NO: 828 - DNA, 46 bp, Artificial Sequence
  Synthesized adaptor oligonucleotide
  misc_feature (34)..(36): n is a, c, g, or t
tgcaggaccagagaattcgaatacaatcgaattnnnctagcgttac

SEQ ID NO: 829 - DNA, 46 bp, Artificial Sequence
  Synthesized adaptor oligonucleotide
  misc_feature (34)..(36): n is a, c, g, or t
tgcaggaccagagaattcgaatacatttttggtnnnctagcgttac

SEQ ID NO: 830 - DNA, 46 bp, Artificial Sequence
  Synthesized adaptor oligonucleotide
  misc_feature (34)..(36): n is a, c, g, or t
tgcaggaccagagaattcgaatacatcagtcctnnnctagcgttac

SEQ ID NO: 831 - DNA, 46 bp, Artificial Sequence
  Synthesized adaptor oligonucleotide
  misc_feature (34)..(36): n is a, c, g, or t
tgcaggaccagagaattcgaatacagtgcacatnnnctagcgttac

SEQ ID NO: 832 - DNA, 46 bp, Artificial Sequence
  Synthesized adaptor oligonucleotide
  misc_feature (34)..(36): n is a, c, g, or t
tgcaggaccagagaattcgaatacagtagaagcnnnctagcgttac

SEQ ID NO: 833 - DNA, 46 bp, Artificial Sequence
  Synthesized adaptor oligonucleotide
  misc_feature (34)..(36): n is a, c, g, or t
tgcaggaccagagaattcgaatacacagcattgnnnctagcgttac

SEQ ID NO: 834 - DNA, 46 bp, Artificial Sequence
  Synthesized adaptor oligonucleotide
  misc_feature (34)..(36): n is a, c, g, or t
tgcaggaccagagaattcgaatacacgcctaggnnnctagcgttac

SEQ ID NO: 835 - DNA, 46 bp, Artificial Sequence
  Synthesized adaptor oligonucleotide
  misc_feature (34)..(36): n is a, c, g, or t
tgcaggaccagagaattcgaatacacagtttggnnnctagcgttac

SEQ ID NO: 836 - DNA, 46 bp, Artificial Sequence
  Synthesized adaptor oligonucleotide
  misc_feature (34)..(36): n is a, c, g, or t
tgcaggaccagagaattcgaatacatcccaagannnctagcgttac

SEQ ID NO: 837 - DNA, 46 bp, Artificial Sequence
  Synthesized adaptor oligonucleotide
  misc_feature (34)..(36): n is a, c, g, or t
tgcaggaccagagaattcgaatacattaggaccnnnctagcgttac

SEQ ID NO: 838 - DNA, 46 bp, Artificial Sequence
  Synthesized adaptor oligonucleotide
  misc_feature (34)..(36): n is a, c, g, or t
tgcaggaccagagaattcgaatacaacaatttgnnnctagcgttac

SEQ ID NO: 839 - DNA, 46 bp, Artificial Sequence
  Synthesized adaptor oligonucleotide
  misc_feature (34)..(36): n is a, c, g, or t
tgcaggaccagagaattcgaatacatgctcgaannnctagcgttac

SEQ ID NO: 840 - DNA, 46 bp, Artificial Sequence
  Synthesized adaptor oligonucleotide
  misc_feature (34)..(36): n is a, c, g, or t
tgcaggaccagagaattcgaatacaggcggtagnnnctagcgttac

SEQ ID NO: 841 - DNA, 46 bp, Artificial Sequence
  Synthesized adaptor oligonucleotide
  misc_feature (34)..(36): n is a, c, g, or t
tgcaggaccagagaattcgaatacaaattaaccnnnctagcgttac

SEQ ID NO: 842 - DNA, 46 bp, Artificial Sequence
  Synthesized adaptor oligonucleotide
  misc_feature (34)..(36): n is a, c, g, or t
tgcaggaccagagaattcgaatacacgacaccgnnnctagcgttac

SEQ ID NO: 843 - DNA, 46 bp, Artificial Sequence
  Synthesized adaptor oligonucleotide
  misc_feature (34)..(36): n is a, c, g, or t
tgcaggaccagagaattcgaatacagtgaggatnnnctagcgttac

SEQ ID NO: 844 - DNA, 46 bp, Artificial Sequence
  Synthesized adaptor oligonucleotide
  misc_feature (34)..(36): n is a, c, g, or t
tgcaggaccagagaattcgaatacaaaattaaannnctagcgttac

SEQ ID NO: 845 - DNA, 46 bp, Artificial Sequence
  Synthesized adaptor oligonucleotide
  misc_feature (34)..(36): n is a, c, g, or t
tgcaggaccagagaattcgaatacacatgccaannnctagcgttac

SEQ ID NO: 846 - DNA, 46 bp, Artificial Sequence
  Synthesized adaptor oligonucleotide
  misc_feature (34)..(36): n is a, c, g, or t
tgcaggaccagagaattcgaatacaccatcagannnctagcgttac

SEQ ID NO: 847 - DNA, 46 bp, Artificial Sequence
  Synthesized adaptor oligonucleotide
  misc_feature (34)..(36): n is a, c, g, or t
tgcaggaccagagaattcgaatacaatataaaannnctagcgttac

SEQ ID NO: 848 - DNA, 46 bp, Artificial Sequence
  Synthesized adaptor oligonucleotide
  misc_feature (34)..(36): n is a, c, g, or t
tgcaggaccagagaattcgaatacagcctccgtnnnctagcgttac

SEQ ID NO: 849 - DNA, 46 bp, Artificial Sequence
  Synthesized adaptor oligonucleotide
  misc_feature (34)..(36): n is a, c, g, or t
tgcaggaccagagaattcgaatacatccaatccnnngatcgacatg

SEQ ID NO: 850 - DNA, 46 bp, Artificial Sequence
  Synthesized adaptor oligonucleotide
  misc_feature (34)..(36): n is a, c, g, or t
tgcaggaccagagaattcgaatacaaaatgcccnnngatcgacatg

SEQ ID NO: 851 - DNA, 46 bp, Artificial Sequence
  Synthesized adaptor oligonucleotide
  misc_feature (34)..(36): n is a, c, g, or t
tgcaggaccagagaattcgaatacaactgtcgannngatcgacatg

SEQ ID NO: 852 - DNA, 46 bp, Artificial Sequence
  Synthesized adaptor oligonucleotide
  misc_feature (34)..(36): n is a, c, g, or t
tgcaggaccagagaattcgaatacagctgttgannngatcgacatg

SEQ ID NO: 853 - DNA, 46 bp, Artificial Sequence
  Synthesized adaptor oligonucleotide
  misc_feature (34)..(36): n is a, c, g, or t
tgcaggaccagagaattcgaatacaggtaacctnnngatcgacatg

SEQ ID NO: 854 - DNA, 46 bp, Artificial Sequence
  Synthesized adaptor oligonucleotide
  misc_feature (34)..(36): n is a, c, g, or t
tgcaggaccagagaattcgaatacacttttcccnnngatcgacatg

SEQ ID NO: 855 - DNA, 46 bp, Artificial Sequence
  Synthesized adaptor oligonucleotide
  misc_feature (34)..(36): n is a, c, g, or t
tgcaggaccagagaattcgaatacagagagccgnnngatcgacatg

SEQ ID NO: 856 - DNA, 46 bp, Artificial Sequence
  Synthesized adaptor oligonucleotide
  misc_feature (34)..(36): n is a, c, g, or t
tgcaggaccagagaattcgaatacacagacagannngatcgacatg

SEQ ID NO: 857 - DNA, 46 bp, Artificial Sequence
  Synthesized adaptor oligonucleotide
  misc_feature (34)..(36): n is a, c, g, or t
tgcaggaccagagaattcgaatacatatatgacnnngatcgacatg

SEQ ID NO: 858 - DNA, 46 bp, Artificial Sequence
  Synthesized adaptor oligonucleotide
  misc_feature (34)..(36): n is a, c, g, or t
tgcaggaccagagaattcgaatacagtccgacgnnngatcgacatg

SEQ ID NO: 859 - DNA, 46 bp, Artificial Sequence
  Synthesized adaptor oligonucleotide
  misc_feature (34)..(36): n is a, c, g, or t
tgcaggaccagagaattcgaatacaactgcatgnnngatcgacatg

SEQ ID NO: 860 - DNA, 46 bp, Artificial Sequence
  Synthesized adaptor oligonucleotide
  misc_feature (34)..(36): n is a, c, g, or t
tgcaggaccagagaattcgaatacatacctaaannngatcgacatg

SEQ ID NO: 861 - DNA, 46 bp, Artificial Sequence
  Synthesized adaptor oligonucleotide
  misc_feature (34)..(36): n is a, c, g, or t
tgcaggaccagagaattcgaatacaaccagatcnnngatcgacatg

SEQ ID NO: 862 - DNA, 46 bp, Artificial Sequence
  Synthesized adaptor oligonucleotide
  misc_feature (34)..(36): n is a, c, g, or t
tgcaggaccagagaattcgaatacaggcaaatgnnngatcgacatg

SEQ ID NO: 863 - DNA, 46 bp, Artificial Sequence
  Synthesized adaptor oligonucleotide
  misc_feature (34)..(36): n is a, c, g, or t
tgcaggaccagagaattcgaatacagaacgtctnnngatcgacatg

SEQ ID NO: 864 - DNA, 46 bp, Artificial Sequence
  Synthesized adaptor oligonucleotide
  misc_feature (34)..(36): n is a, c, g, or t
tgcaggaccagagaattcgaatacaccaccaaannngatcgacatg

SEQ ID NO: 865 - DNA, 46 bp, Artificial Sequence
  Synthesized adaptor oligonucleotide
  misc_feature (34)..(36): n is a, c, g, or t
tgcaggaccagagaattcgaatacattttccaannngatcgacatg

SEQ ID NO: 866 - DNA, 46 bp, Artificial Sequence
  Synthesized adaptor oligonucleotide
  misc_feature (34)..(36): n is a, c, g, or t
tgcaggaccagagaattcgaatacagttagttannngatcgacatg

SEQ ID NO: 867 - DNA, 46 bp, Artificial Sequence
  Synthesized adaptor oligonucleotide
  misc_feature (34)..(36): n is a, c, g, or t
tgcaggaccagagaattcgaatacatcagctctnnngatcgacatg

SEQ ID NO: 868 - DNA, 46 bp, Artificial Sequence
  Synthesized adaptor oligonucleotide
  misc_feature (34)..(36): n is a, c, g, or t
tgcaggaccagagaattcgaatacatgcggaggnnngatcgacatg

SEQ ID NO: 869 - DNA, 46 bp, Artificial Sequence
  Synthesized adaptor oligonucleotide
  misc_feature (34)..(36): n is a, c, g, or t
tgcaggaccagagaattcgaatacatctgcaagnnngatcgacatg

SEQ ID NO: 870 - DNA, 46 bp, Artificial Sequence
  Synthesized adaptor oligonucleotide
  misc_feature (34)..(36): n is a, c, g, or t
tgcaggaccagagaattcgaatacatctaacccnnngatcgacatg

SEQ ID NO: 871 - DNA, 46 bp, Artificial Sequence
  Synthesized adaptor oligonucleotide
  misc_feature (34)..(36): n is a, c, g, or t
tgcaggaccagagaattcgaatacacgtaggaannngatcgacatg

SEQ ID NO: 872 - DNA, 46 bp, Artificial Sequence
  Synthesized adaptor oligonucleotide
  misc_feature (34)..(36): n is a, c, g, or t
tgcaggaccagagaattcgaatacacaagactcnnngatcgacatg

SEQ ID NO: 873 - DNA, 46 bp, Artificial Sequence
  Synthesized adaptor oligonucleotide
  misc_feature (34)..(36): n is a, c, g, or t
tgcaggaccagagaattcgaatacattccgtgtnnngatcgacatg

SEQ ID NO: 874 - DNA, 46 bp, Artificial Sequence
  Synthesized adaptor oligonucleotide
  misc_feature (34)..(36): n is a, c, g, or t
tgcaggaccagagaattcgaatacagtgaacgannngatcgacatg

SEQ ID NO: 875 - DNA, 46 bp, Artificial Sequence
  Synthesized adaptor oligonucleotide
  misc_feature (34)..(36): n is a, c, g, or t
tgcaggaccagagaattcgaatacagctaaaccnnngatcgacatg

SEQ ID NO: 876 - DNA, 46 bp, Artificial Sequence
  Synthesized adaptor oligonucleotide
  misc_feature (34)..(36): n is a, c, g, or t
tgcaggaccagagaattcgaatacacaattttcnnngatcgacatg

SEQ ID NO: 877 - DNA, 46 bp, Artificial Sequence
  Synthesized adaptor oligonucleotide
  misc_feature (34)..(36): n is a, c, g, or t
tgcaggaccagagaattcgaatacatgaggaacnnngatcgacatg

SEQ ID NO: 878 - DNA, 46 bp, Artificial Sequence
  Synthesized adaptor oligonucleotide
  misc_feature (34)..(36): n is a, c, g, or t
tgcaggaccagagaattcgaatacagtaatctannngatcgacatg

SEQ ID NO: 879 - DNA, 46 bp, Artificial Sequence
  Synthesized adaptor oligonucleotide
  misc_feature (34)..(36): n is a, c, g, or t
tgcaggaccagagaattcgaatacatatctccgnnngatcgacatg

SEQ ID NO: 880 - DNA, 46 bp, Artificial Sequence
  Synthesized adaptor oligonucleotide
  misc_feature (34)..(36): n is a, c, g, or t
tgcaggaccagagaattcgaatacagctacggcnnngatcgacatg

SEQ ID NO: 881 - DNA, 46 bp, Artificial Sequence
  Synthesized adaptor oligonucleotide
  misc_feature (34)..(36): n is a, c, g, or t
tgcaggaccagagaattcgaatacaatatctgannngatcgacatg

SEQ ID NO: 882 - DNA, 46 bp, Artificial Sequence
  Synthesized adaptor oligonucleotide
  misc_feature (34)..(36): n is a, c, g, or t
tgcaggaccagagaattcgaatacatacttagannngatcgacatg

SEQ ID NO: 883 - DNA, 46 bp, Artificial Sequence
  Synthesized adaptor oligonucleotide
  misc_feature (34)..(36): n is a, c, g, or t
tgcaggaccagagaattcgaatacatcattttgnnngatcgacatg

SEQ ID NO: 884 - DNA, 46 bp, Artificial Sequence
  Synthesized adaptor oligonucleotide
  misc_feature (34)..(36): n is a, c, g, or t
tgcaggaccagagaattcgaatacagcgtggagnnngatcgacatg

SEQ ID NO: 885 - DNA, 46 bp, Artificial Sequence
  Synthesized adaptor oligonucleotide
  misc_feature (34)..(36): n is a, c, g, or t
tgcaggaccagagaattcgaatacataagacggnnngatcgacatg

SEQ ID NO: 886 - DNA, 46 bp, Artificial Sequence
  Synthesized adaptor oligonucleotide
  misc_feature (34)..(36): n is a, c, g, or t
tgcaggaccagagaattcgaatacaaggccttannngatcgacatg

SEQ ID NO: 887 - DNA, 46 bp, Artificial Sequence
  Synthesized adaptor oligonucleotide
  misc_feature (34)..(36): n is a, c, g, or t
tgcaggaccagagaattcgaatacacatctcacnnngatcgacatg

SEQ ID NO: 888 - DNA, 46 bp, Artificial Sequence
  Synthesized adaptor oligonucleotide
  misc_feature (34)..(36): n is a, c, g, or t
tgcaggaccagagaattcgaatacatgcgatcannngatcgacatg

SEQ ID NO: 889 - DNA, 46 bp, Artificial Sequence
  Synthesized adaptor oligonucleotide
  misc_feature (34)..(36): n is a, c, g, or t
tgcaggaccagagaattcgaatacacggaggacnnngatcgacatg

SEQ ID NO: 890 - DNA, 46 bp, Artificial Sequence
  Synthesized adaptor oligonucleotide
  misc_feature (34)..(36): n is a, c, g, or t
tgcaggaccagagaattcgaatacaactaattgnnngatcgacatg

SEQ ID NO: 891 - DNA, 46 bp, Artificial Sequence
  Synthesized adaptor oligonucleotide
  misc_feature (34)..(36): n is a, c, g, or t
tgcaggaccagagaattcgaatacatgcctagannngatcgacatg

SEQ ID NO: 892 - DNA, 46 bp, Artificial Sequence
  Synthesized adaptor oligonucleotide
  misc_feature (34)..(36): n is a, c, g, or t
tgcaggaccagagaattcgaatacactatccgtnnngatcgacatg

SEQ ID NO: 893 - DNA, 46 bp, Artificial Sequence
  Synthesized adaptor oligonucleotide
  misc_feature (34)..(36): n is a, c, g, or t
tgcaggaccagagaattcgaatacatgccaggcnnngatcgacatg

SEQ ID NO: 894 - DNA, 46 bp, Artificial Sequence
  Synthesized adaptor oligonucleotide
  misc_feature (34)..(36): n is a, c, g, or t
tgcaggaccagagaattcgaatacagcggagcannngatcgacatg

SEQ ID NO: 895 - DNA, 46 bp, Artificial Sequence
  Synthesized adaptor oligonucleotide
  misc_feature (34)..(36): n is a, c, g, or t
tgcaggaccagagaattcgaatacaagacccatnnngatcgacatg

SEQ ID NO: 896 - DNA, 46 bp, Artificial Sequence
  Synthesized adaptor oligonucleotide
  misc_feature (34)..(36): n is a, c, g, or t
tgcaggaccagagaattcgaatacattgacctcnnngatcgacatg

SEQ ID NO: 897 - DNA, 46 bp, Artificial Sequence
  Synthesized adaptor oligonucleotide
  misc_feature (34)..(36): n is a, c, g, or t
tgcaggaccagagaattcgaatacacttgctcannngatcgacatg

SEQ ID NO: 898 - DNA, 46 bp, Artificial Sequence
  Synthesized adaptor oligonucleotide
  misc_feature (34)..(36): n is a, c, g, or t
tgcaggaccagagaattcgaatacaatgctgcannngatcgacatg

SEQ ID NO: 899 - DNA, 46 bp, Artificial Sequence
  Synthesized adaptor oligonucleotide
  misc_feature (34)..(36): n is a, c, g, or t
tgcaggaccagagaattcgaatacaaacggacannngatcgacatg

SEQ ID NO: 900 - DNA, 46 bp, Artificial Sequence
  Synthesized adaptor oligonucleotide
  misc_feature (34)..(36): n is a, c, g, or t
tgcaggaccagagaattcgaatacagcgatcatnnngatcgacatg

SEQ ID NO: 901 - DNA, 46 bp, Artificial Sequence
  Synthesized adaptor oligonucleotide
  misc_feature (34)..(36): n is a, c, g, or t
tgcaggaccagagaattcgaatacatgagacagnnngatcgacatg

SEQ ID NO: 902 - DNA, 46 bp, Artificial Sequence
  Synthesized adaptor oligonucleotide
  misc_feature (34)..(36): n is a, c, g, or t
tgcaggaccagagaattcgaatacagccactggnnngatcgacatg

SEQ ID NO: 903 - DNA, 46 bp, Artificial Sequence
  Synthesized adaptor oligonucleotide
  misc_feature (34)..(36): n is a, c, g, or t
tgcaggaccagagaattcgaatacaggtttgacnnngatcgacatg

SEQ ID NO: 904 - DNA, 46 bp, Artificial Sequence
  Synthesized adaptor oligonucleotide
  misc_feature (34)..(36): n is a, c, g, or t
tgcaggaccagagaattcgaatacaaacttggcnnngatcgacatg

SEQ ID NO: 905 - DNA, 46 bp, Artificial Sequence
  Synthesized adaptor oligonucleotide
  misc_feature (34)..(36): n is a, c, g, or t
tgcaggaccagagaattcgaatacaacctaatannngatcgacatg

SEQ ID NO: 906 - DNA, 46 bp, Artificial Sequence
  Synthesized adaptor oligonucleotide
  misc_feature (34)..(36): n is a, c, g, or t
tgcaggaccagagaattcgaatacagcacagaannngatcgacatg

SEQ ID NO: 907 - DNA, 46 bp, Artificial Sequence
  Synthesized adaptor oligonucleotide
  misc_feature (34)..(36): n is a, c, g, or t
tgcaggaccagagaattcgaatacatgtgtcagnnngatcgacatg

SEQ ID NO: 908 - DNA, 46 bp, Artificial Sequence
  Synthesized adaptor oligonucleotide
  misc_feature (34)..(36): n is a, c, g, or t
tgcaggaccagagaattcgaatacaagtaacaannngatcgacatg

SEQ ID NO: 909 - DNA, 46 bp, Artificial Sequence
  Synthesized adaptor oligonucleotide
  misc_feature (34)..(36): n is a, c, g, or t
tgcaggaccagagaattcgaatacatctgagcannntgcatcaggt

SEQ ID NO: 910 - DNA, 46 bp, Artificial Sequence
  Synthesized adaptor oligonucleotide
  misc_feature (34)..(36): n is a, c, g, or t
tgcaggaccagagaattcgaatacaagtggaacnnntgcatcaggt

SEQ ID NO: 911 - DNA, 46 bp, Artificial Sequence
  Synthesized adaptor oligonucleotide
  misc_feature (34)..(36): n is a, c, g, or t
tgcaggaccagagaattcgaatacagaactcgtnnntgcatcaggt

SEQ ID NO: 912 - DNA, 46 bp, Artificial Sequence
  Synthesized adaptor oligonucleotide
  misc_feature (34)..(36): n is a, c, g, or t
tgcaggaccagagaattcgaatacagcaggcgannntgcatcaggt

SEQ ID NO: 913 - DNA, 46 bp, Artificial Sequence
  Synthesized adaptor oligonucleotide
  misc_feature (34)..(36): n is a, c, g, or t
tgcaggaccagagaattcgaatacaggctctccnnntgcatcaggt

SEQ ID NO: 914 - DNA, 46 bp, Artificial Sequence
  Synthesized adaptor oligonucleotide
  misc_feature (34)..(36): n is a, c, g, or t
tgcaggaccagagaattcgaatacaaatacatcnnntgcatcaggt

SEQ ID NO: 915 - DNA, 46 bp, Artificial Sequence
  Synthesized adaptor oligonucleotide
  misc_feature (34)..(36): n is a, c, g, or t
tgcaggaccagagaattcgaatacaaggtcaagnnntgcatcaggt

SEQ ID NO: 916 - DNA, 46 bp, Artificial Sequence
  Synthesized adaptor oligonucleotide
  misc_feature (34)..(36): n is a, c, g, or t
tgcaggaccagagaattcgaatacatgagccgcnnntgcatcaggt

SEQ ID NO: 917 - DNA, 46 bp, Artificial Sequence
  Synthesized adaptor oligonucleotide
  misc_feature (34)..(36): n is a, c, g, or t
tgcaggaccagagaattcgaatacattagtttcnnntgcatcaggt

SEQ ID NO: 918 - DNA, 46 bp, Artificial Sequence
  Synthesized adaptor oligonucleotide
  misc_feature (34)..(36): n is a, c, g, or t
tgcaggaccagagaattcgaatacagtcgtagtnnntgcatcaggt

SEQ ID NO: 919 - DNA, 46 bp, Artificial Sequence
  Synthesized adaptor oligonucleotide
  misc_feature (34)..(36): n is a, c, g, or t
tgcaggaccagagaattcgaatacaaaaggattnnntgcatcaggt

SEQ ID NO: 920 - DNA, 46 bp, Artificial Sequence
  Synthesized adaptor oligonucleotide
  misc_feature (34)..(36): n is a, c, g, or t
tgcaggaccagagaattcgaatacatttttagcnnntgcatcaggt

SEQ ID NO: 921 - DNA, 46 bp, Artificial Sequence
  Synthesized adaptor oligonucleotide
  misc_feature (34)..(36): n is a, c, g, or t
tgcaggaccagagaattcgaatacaataactcannntgcatcaggt

SEQ ID NO: 922 - DNA, 46 bp, Artificial Sequence
  Synthesized adaptor oligonucleotide
  misc_feature (34)..(36): n is a, c, g, or t
tgcaggaccagagaattcgaatacattttaaccnnntgcatcaggt

SEQ ID NO: 923 - DNA, 46 bp, Artificial Sequence
  Synthesized adaptor oligonucleotide
  misc_feature (34)..(36): n is a, c, g, or t
tgcaggaccagagaattcgaatacagtgccgacnnntgcatcaggt

SEQ ID NO: 924 - DNA, 46 bp, Artificial Sequence
  Synthesized adaptor oligonucleotide
  misc_feature (34)..(36): n is a, c, g, or t
tgcaggaccagagaattcgaatacagaatagatnnntgcatcaggt

SEQ ID NO: 925 - DNA, 46 bp, Artificial Sequence
  Synthesized adaptor oligonucleotide
  misc_feature (34)..(36): n is a, c, g, or t
tgcaggaccagagaattcgaatacagctgagccnnntgcatcaggt

SEQ ID NO: 926 - DNA, 46 bp, Artificial Sequence
  Synthesized adaptor oligonucleotide
  misc_feature (34)..(36): n is a, c, g, or t
tgcaggaccagagaattcgaatacaacaggcaannntgcatcaggt

SEQ ID NO: 927 - DNA, 46 bp, Artificial Sequence
  Synthesized adaptor oligonucleotide
  misc_feature (34)..(36): n is a, c, g, or t
tgcaggaccagagaattcgaatacagaccgcacnnntgcatcaggt

SEQ ID NO: 928 - DNA, 46 bp, Artificial Sequence
  Synthesized adaptor oligonucleotide
  misc_feature (34)..(36): n is a, c, g, or t
tgcaggaccagagaattcgaatacacttattcannntgcatcaggt

SEQ ID NO: 929 - DNA, 46 bp, Artificial Sequence
  Synthesized adaptor oligonucleotide
  misc_feature (34)..(36): n is a, c, g, or t
tgcaggaccagagaattcgaatacagtgtgctannntgcatcaggt

SEQ ID NO: 930 - DNA, 46 bp, Artificial Sequence
  Synthesized adaptor oligonucleotide
  misc_feature (34)..(36): n is a, c, g, or t
tgcaggaccagagaattcgaatacaatttagtgnnntgcatcaggt

SEQ ID NO: 931 - DNA, 46 bp, Artificial Sequence
  Synthesized adaptor oligonucleotide
  misc_feature (34)..(36): n is a, c, g, or t
tgcaggaccagagaattcgaatacatcggagaannntgcatcaggt

SEQ ID NO: 932 - DNA, 46 bp, Artificial Sequence
  Synthesized adaptor oligonucleotide
  misc_feature (34)..(36): n is a, c, g, or t
tgcaggaccagagaattcgaatacacgccgaacnnntgcatcaggt

SEQ ID NO: 933 - DNA, 46 bp, Artificial Sequence
  Synthesized adaptor oligonucleotide
  misc_feature (34)..(36): n is a, c, g, or t
tgcaggaccagagaattcgaatacagcttcgccnnntgcatcaggt

SEQ ID NO: 934 - DNA, 46 bp, Artificial Sequence
  Synthesized adaptor oligonucleotide
  misc_feature (34)..(36): n is a, c, g, or t
tgcaggaccagagaattcgaatacaacaatcatnnntgcatcaggt

SEQ ID NO: 935 - DNA, 46 bp, Artificial Sequence
  Synthesized adaptor oligonucleotide
  misc_feature (34)..(36): n is a, c, g, or t
tgcaggaccagagaattcgaatacatgatcgcannntgcatcaggt

SEQ ID NO: 936 - DNA, 46 bp, Artificial Sequence
  Synthesized adaptor oligonucleotide
  misc_feature (34)..(36): n is a, c, g, or t
tgcaggaccagagaattcgaatacacacagtacnnntgcatcaggt

SEQ ID NO: 937 - DNA, 46 bp, Artificial Sequence
  Synthesized adaptor oligonucleotide
  misc_feature (34)..(36): n is a, c, g, or t
tgcaggaccagagaattcgaatacagtcaagtcnnntgcatcaggt

SEQ ID NO: 938 - DNA, 46 bp, Artificial Sequence
  Synthesized adaptor oligonucleotide
  misc_feature (34)..(36): n is a, c, g, or t
tgcaggaccagagaattcgaatacagctcccacnnntgcatcaggt

SEQ ID NO: 939 - DNA, 46 bp, Artificial Sequence
  Synthesized adaptor oligonucleotide
  misc_feature (34)..(36): n is a, c, g, or t
tgcaggaccagagaattcgaatacattacttgtnnntgcatcaggt

SEQ ID NO: 940 - DNA, 46 bp, Artificial Sequence
  Synthesized adaptor oligonucleotide
  misc_feature (34)..(36): n is a, c, g, or t
tgcaggaccagagaattcgaatacataatgtgtnnntgcatcaggt

SEQ ID NO: 941 - DNA, 46 bp, Artificial Sequence
  Synthesized adaptor oligonucleotide
  misc_feature (34)..(36): n is a, c, g, or t
tgcaggaccagagaattcgaatacataccatttnnntgcatcaggt

SEQ ID NO: 942 - DNA, 46 bp, Artificial Sequence
  Synthesized adaptor oligonucleotide
  misc_feature (34)..(36): n is a, c, g, or t
tgcaggaccagagaattcgaatacagtccgtaannntgcatcaggt

SEQ ID NO: 943 - DNA, 46 bp, Artificial Sequence
  Synthesized adaptor oligonucleotide
  misc_feature (34)..(36): n is a, c, g, or t
tgcaggaccagagaattcgaatacaagcggtaannntgcatcaggt

SEQ ID NO: 944 - DNA, 46 bp, Artificial Sequence
  Synthesized adaptor oligonucleotide
  misc_feature (34)..(36): n is a, c, g, or t
tgcaggaccagagaattcgaatacaggaaactgnnntgcatcaggt

SEQ ID NO: 945 - DNA, 46 bp, Artificial Sequence
  Synthesized adaptor oligonucleotide
  misc_feature (34)..(36): n is a, c, g, or t
tgcaggaccagagaattcgaatacaggccacgtnnntgcatcaggt

SEQ ID NO: 946 - DNA, 46 bp, Artificial Sequence
  Synthesized adaptor oligonucleotide
  misc_feature (34)..(36): n is a, c, g, or t
tgcaggaccagagaattcgaatacatcattgaannntgcatcaggt

SEQ ID NO: 947 - DNA, 46 bp, Artificial Sequence
  Synthesized adaptor oligonucleotide
  misc_feature (34)..(36): n is a, c, g, or t
tgcaggaccagagaattcgaatacagcgtcaatnnntgcatcaggt

SEQ ID NO: 948 - DNA, 46 bp, Artificial Sequence
  Synthesized adaptor oligonucleotide
  misc_feature (34)..(36): n is a, c, g, or t
tgcaggaccagagaattcgaatacacggaagcgnnntgcatcaggt

SEQ ID NO: 949 - DNA, 46 bp, Artificial Sequence
  Synthesized adaptor oligonucleotide
  misc_feature (34)..(36): n is a, c, g, or t
tgcaggaccagagaattcgaatacagttcgaacnnntgcatcaggt

SEQ ID NO: 950 - DNA, 46 bp, Artificial Sequence
  Synthesized adaptor oligonucleotide
  misc_feature (34)..(36): n is a, c, g, or t
tgcaggaccagagaattcgaatacaggccccttnnntgcatcaggt

SEQ ID NO: 951 - DNA, 46 bp, Artificial Sequence
  Synthesized adaptor oligonucleotide
  misc_feature (34)..(36): n is a, c, g, or t
tgcaggaccagagaattcgaatacaatggctcannntgcatcaggt

SEQ ID NO: 952 - DNA, 46 bp, Artificial Sequence
  Synthesized adaptor oligonucleotide
  misc_feature (34)..(36): n is a, c, g, or t
tgcaggaccagagaattcgaatacattgacggtnnntgcatcaggt

SEQ ID NO: 953 - DNA, 46 bp, Artificial Sequence
  Synthesized adaptor oligonucleotide
  misc_feature (34)..(36): n is a, c, g, or t
tgcaggaccagagaattcgaatacatggacgttnnntgcatcaggt

SEQ ID NO: 954 - DNA, 46 bp, Artificial Sequence
  Synthesized adaptor oligonucleotide
  misc_feature (34)..(36): n is a, c, g, or t
tgcaggaccagagaattcgaatacatgacagtcnnntgcatcaggt

SEQ ID NO: 955 - DNA, 46 bp, Artificial Sequence
  Synthesized adaptor oligonucleotide
  misc_feature (34)..(36): n is a, c, g, or t
tgcaggaccagagaattcgaatacactacctgtnnntgcatcaggt

SEQ ID NO: 956 - DNA, 46 bp, Artificial Sequence
  Synthesized adaptor oligonucleotide
  misc_feature (34)..(36): n is a, c, g, or t
tgcaggaccagagaattcgaatacaaggtcccgnnntgcatcaggt

SEQ ID NO: 957 - DNA, 46 bp, Artificial Sequence
  Synthesized adaptor oligonucleotide
  misc_feature (34)..(36): n is a, c, g, or t
tgcaggaccagagaattcgaatacattcatctannntgcatcaggt

SEQ ID NO: 958 - DNA, 46 bp, Artificial Sequence
  Synthesized adaptor oligonucleotide
  misc_feature (34)..(36): n is a, c, g, or t
tgcaggaccagagaattcgaatacagataaagtnnntgcatcaggt

SEQ ID NO: 959 - DNA, 46 bp, Artificial Sequence
  Synthesized adaptor oligonucleotide
  misc_feature (34)..(36): n is a, c, g, or t
tgcaggaccagagaattcgaatacacacggaaannntgcatcaggt

SEQ ID NO: 960 - DNA, 46 bp, Artificial Sequence
  Synthesized adaptor oligonucleotide
  misc_feature (34)..(36): n is a, c, g, or t
tgcaggaccagagaattcgaatacatgtgaggannntgcatcaggt

SEQ ID NO: 961 - DNA, 46 bp, Artificial Sequence
  Synthesized adaptor oligonucleotide
  misc_feature (34)..(36): n is a, c, g, or t
tgcaggaccagagaattcgaatacacgtgatcannntgcatcaggt

SEQ ID NO: 962 - DNA, 46 bp, Artificial Sequence
  Synthesized adaptor oligonucleotide
  misc_feature (34)..(36): n is a, c, g, or t
tgcaggaccagagaattcgaatacatgcgttgannntgcatcaggt

SEQ ID NO: 963 - DNA, 46 bp, Artificial Sequence
  Synthesized adaptor oligonucleotide
  misc_feature (34)..(36): n is a, c, g, or t
tgcaggaccagagaattcgaatacatcgctccgnnntgcatcaggt

SEQ ID NO: 964 - DNA, 46 bp, Artificial Sequence
  Synthesized adaptor oligonucleotide
  misc_feature (34)..(36): n is a, c, g, or t
tgcaggaccagagaattcgaatacaccagtcaannntgcatcaggt

SEQ ID NO: 965 - DNA, 46 bp, Artificial Sequence
  Synthesized adaptor oligonucleotide
  misc_feature (34)..(36): n is a, c, g, or t
tgcaggaccagagaattcgaatacacacattccnnntgcatcaggt

SEQ ID NO: 966 - DNA, 46 bp, Artificial Sequence
  Synthesized adaptor oligonucleotide
  misc_feature (34)..(36): n is a, c, g, or t
tgcaggaccagagaattcgaatacaggtatattnnntgcatcaggt

SEQ ID NO: 967 - DNA, 46 bp, Artificial Sequence
  Synthesized adaptor oligonucleotide
  misc_feature (34)..(36): n is a, c, g, or t
tgcaggaccagagaattcgaatacataagatgannntgcatcaggt

SEQ ID NO: 968 - DNA, 46 bp, Artificial Sequence
  Synthesized adaptor oligonucleotide
  misc_feature (34)..(36): n is a, c, g, or t
tgcaggaccagagaattcgaatacattaaaattnnntgcatcaggt

SEQ ID NO: 969 - DNA, 46 bp, Artificial Sequence
  Synthesized adaptor oligonucleotide
  misc_feature (34)..(36): n is a, c, g, or t
tgcaggaccagagaattcgaatacagcgattacnnnacgtatgcca

SEQ ID NO: 970 - DNA, 46 bp, Artificial Sequence
  Synthesized adaptor oligonucleotide
  misc_feature (34)..(36): n is a, c, g, or t
tgcaggaccagagaattcgaatacatagtcctcnnnacgtatgcca

SEQ ID NO: 971 - DNA, 46 bp, Artificial Sequence
  Synthesized adaptor oligonucleotide
  misc_feature (34)..(36): n is a, c, g, or t
tgcaggaccagagaattcgaatacagttataacnnnacgtatgcca

SEQ ID NO: 972 - DNA, 46 bp, Artificial Sequence
  Synthesized adaptor oligonucleotide
  misc_feature (34)..(36): n is a, c, g, or t
tgcaggaccagagaattcgaatacatatcttcannnacgtatgcca

SEQ ID NO: 973 - DNA, 46 bp, Artificial Sequence
  Synthesized adaptor oligonucleotide
  misc_feature (34)..(36): n is a, c, g, or t
tgcaggaccagagaattcgaatacaacgttcgannnacgtatgcca

SEQ ID NO: 974 - DNA, 46 bp, Artificial Sequence
  Synthesized adaptor oligonucleotide
  misc_feature (34)..(36): n is a, c, g, or t
tgcaggaccagagaattcgaatacaactcgtgannnacgtatgcca

SEQ ID NO: 975 - DNA, 46 bp, Artificial Sequence
  Synthesized adaptor oligonucleotide
  misc_feature (34)..(36): n is a, c, g, or t
tgcaggaccagagaattcgaatacaggactactnnnacgtatgcca

SEQ ID NO: 976 - DNA, 46 bp, Artificial Sequence
  Synthesized adaptor oligonucleotide
  misc_feature (34)..(36): n is a, c, g, or t
tgcaggaccagagaattcgaatacatctgtaccnnnacgtatgcca

SEQ ID NO: 977 - DNA, 46 bp, Artificial Sequence
  Synthesized adaptor oligonucleotide
  misc_feature (34)..(36): n is a, c, g, or t
tgcaggaccagagaattcgaatacaccctaactnnnacgtatgcca

SEQ ID NO: 978 - DNA, 46 bp, Artificial Sequence
  Synthesized adaptor oligonucleotide
  misc_feature (34)..(36): n is a, c, g, or t
tgcaggaccagagaattcgaatacattggagagnnnacgtatgcca

SEQ ID NO: 979 - DNA, 46 bp, Artificial Sequence
  Synthesized adaptor oligonucleotide
  misc_feature (34)..(36): n is a, c, g, or t
tgcaggaccagagaattcgaatacagaatcaaannnacgtatgcca

SEQ ID NO: 980 - DNA, 46 bp, Artificial Sequence
  Synthesized adaptor oligonucleotide
  misc_feature (34)..(36): n is a, c, g, or t
tgcaggaccagagaattcgaatacagtttcgtcnnnacgtatgcca

SEQ ID NO: 981 - DNA, 46 bp, Artificial Sequence
  Synthesized adaptor oligonucleotide
  misc_feature (34)..(36): n is a, c, g, or t
tgcaggaccagagaattcgaatacactacacagnnnacgtatgcca

SEQ ID NO: 982 - DNA, 46 bp, Artificial Sequence
  Synthesized adaptor oligonucleotide
  misc_feature (34)..(36): n is a, c, g, or t
tgcaggaccagagaattcgaatacaagtcagtcnnnacgtatgcca

SEQ ID NO: 983 - DNA, 46 bp, Artificial Sequence
  Synthesized adaptor oligonucleotide
  misc_feature (34)..(36): n is a, c, g, or t
tgcaggaccagagaattcgaatacacaacgagannnacgtatgcca

SEQ ID NO: 984 - DNA, 46 bp, Artificial Sequence
  Synthesized adaptor oligonucleotide
  misc_feature (34)..(36): n is a, c, g, or t
tgcaggaccagagaattcgaatacataggctcannnacgtatgcca

SEQ ID NO: 985 - DNA, 46 bp, Artificial Sequence
  Synthesized adaptor oligonucleotide
  misc_feature (34)..(36): n is a, c, g, or t
tgcaggaccagagaattcgaatacaggcccatgnnnacgtatgcca

SEQ ID NO: 986 - DNA, 46 bp, Artificial Sequence
  Synthesized adaptor oligonucleotide
  misc_feature (34)..(36): n is a, c, g, or t
tgcaggaccagagaattcgaatacaggcagtccnnnacgtatgcca

SEQ ID NO: 987 - DNA, 46 bp, Artificial Sequence
  Synthesized adaptor oligonucleotide
  misc_feature (34)..(36): n is a, c, g, or t
tgcaggaccagagaattcgaatacatcgattggnnnacgtatgcca

SEQ ID NO: 988 - DNA, 46 bp, Artificial Sequence
  Synthesized adaptor oligonucleotide
  misc_feature (34)..(36): n is a, c, g, or t
tgcaggaccagagaattcgaatacatagacaggnnnacgtatgcca

SEQ ID NO: 989 - DNA, 46 bp, Artificial Sequence
  Synthesized adaptor oligonucleotide
  misc_feature (34)..(36): n is a, c, g, or t
tgcaggaccagagaattcgaatacaactaagttnnnacgtatgcca

SEQ ID NO: 990 - DNA, 46 bp, Artificial Sequence
  Synthesized adaptor oligonucleotide
  misc_feature (34)..(36): n is a, c, g, or t
tgcaggaccagagaattcgaatacaatgttcggnnnacgtatgcca

SEQ ID NO: 991 - DNA, 46 bp, Artificial Sequence
  Synthesized adaptor oligonucleotide
  misc_feature (34)..(36): n is a, c, g, or t
tgcaggaccagagaattcgaatacaagcccaatnnnacgtatgcca

SEQ ID NO: 992 - DNA, 46 bp, Artificial Sequence
  Synthesized adaptor oligonucleotide
  misc_feature (34)..(36): n is a, c, g, or t
tgcaggaccagagaattcgaatacagtgagttcnnnacgtatgcca

SEQ ID NO: 993 - DNA, 46 bp, Artificial Sequence
  Synthesized adaptor oligonucleotide
  misc_feature (34)..(36): n is a, c, g, or t
tgcaggaccagagaattcgaatacagtgctaacnnnacgtatgcca

SEQ ID NO: 994 - DNA, 46 bp, Artificial Sequence
  Synthesized adaptor oligonucleotide
  misc_feature (34)..(36): n is a, c, g, or t
tgcaggaccagagaattcgaatacagccaccgannnacgtatgcca

SEQ ID NO: 995 - DNA, 46 bp, Artificial Sequence
  Synthesized adaptor oligonucleotide
  misc_feature (34)..(36): n is a, c, g, or t
tgcaggaccagagaattcgaatacaagtccgatnnnacgtatgcca

SEQ ID NO: 996 - DNA, 46 bp, Artificial Sequence
  Synthesized adaptor oligonucleotide
  misc_feature (34)..(36): n is a, c, g, or t
tgcaggaccagagaattcgaatacagttaaatcnnnacgtatgcca

SEQ ID NO: 997 - DNA, 46 bp, Artificial Sequence
  Synthesized adaptor oligonucleotide
  misc_feature (34)..(36): n is a, c, g, or t
tgcaggaccagagaattcgaatacaactgactgnnnacgtatgcca

SEQ ID NO: 998 - DNA, 46 bp, Artificial Sequence
  Synthesized adaptor oligonucleotide
  misc_feature (34)..(36): n is a, c, g, or t
tgcaggaccagagaattcgaatacacttcatgcnnnacgtatgcca

SEQ ID NO: 999 - DNA, 46 bp, Artificial Sequence
  Synthesized adaptor oligonucleotide
  misc_feature (34)..(36): n is a, c, g, or t
tgcaggaccagagaattcgaatacaaccagcatnnnacgtatgcca

SEQ ID NO: 1000 - DNA, 46 bp, Artificial Sequence
  Synthesized adaptor oligonucleotide
  misc_feature (34)..(36): n is a, c, g, or t
tgcaggaccagagaattcgaatacaggcgtccannnacgtatgcca

SEQ ID NO: 1001 - DNA, 46 bp, Artificial Sequence
  Synthesized adaptor oligonucleotide
  misc_feature (34)..(36): n is a, c, g, or t
tgcaggaccagagaattcgaatacaaacaacccnnnacgtatgcca

SEQ ID NO: 1002 - DNA, 46 bp, Artificial Sequence
  Synthesized adaptor oligonucleotide
  misc_feature (34)..(36): n is a, c, g, or t
tgcaggaccagagaattcgaatacaggtcttagnnnacgtatgcca

SEQ ID NO: 1003 - DNA, 46 bp, Artificial Sequence
  Synthesized adaptor oligonucleotide
  misc_feature (34)..(36): n is a, c, g, or t
tgcaggaccagagaattcgaatacagcccggatnnnacgtatgcca

SEQ ID NO: 1004 - DNA, 46 bp, Artificial Sequence
  Synthesized adaptor oligonucleotide
  misc_feature (34)..(36): n is a, c, g, or t
tgcaggaccagagaattcgaatacaatcccgaannnacgtatgcca

SEQ ID NO: 1005 - DNA, 46 bp, Artificial Sequence
  Synthesized adaptor oligonucleotide
  misc_feature (34)..(36): n is a, c, g, or t
tgcaggaccagagaattcgaatacatttactcannnacgtatgcca

SEQ ID NO: 1006 - DNA, 46 bp, Artificial Sequence
  Synthesized adaptor oligonucleotide
  misc_feature (34)..(36): n is a, c, g, or t
tgcaggaccagagaattcgaatacatccaccgcnnnacgtatgcca

SEQ ID NO: 1007 - DNA, 46 bp, Artificial Sequence
  Synthesized adaptor oligonucleotide
  misc_feature (34)..(36): n is a, c, g, or t
tgcaggaccagagaattcgaatacaccagattgnnnacgtatgcca

SEQ ID NO: 1008 - DNA, 46 bp, Artificial Sequence
  Synthesized adaptor oligonucleotide
  misc_feature (34)..(36): n is a, c, g, or t
tgcaggaccagagaattcgaatacacatggtcannnacgtatgcca

SEQ ID NO: 1009 - DNA, 46 bp, Artificial Sequence
  Synthesized adaptor oligonucleotide
  misc_feature (34)..(36): n is a, c, g, or t
tgcaggaccagagaattcgaatacaccatttcgnnnacgtatgcca

SEQ ID NO: 1010 - DNA, 46 bp, Artificial Sequence
  Synthesized adaptor oligonucleotide
  misc_feature (34)..(36): n is a, c, g, or t
tgcaggaccagagaattcgaatacatgtcgcggnnnacgtatgcca

SEQ ID NO: 1011 - DNA, 46 bp, Artificial Sequence
  Synthesized adaptor oligonucleotide
  misc_feature (34)..(36): n is a, c, g, or t
tgcaggaccagagaattcgaatacaaacaatagnnnacgtatgcca

SEQ ID NO: 1012 - DNA, 46 bp, Artificial Sequence
  Synthesized adaptor oligonucleotide
  misc_feature (34)..(36): n is a, c, g, or t
tgcaggaccagagaattcgaatacattcgacgannnacgtatgcca

SEQ ID NO: 1013 - DNA, 46 bp, Artificial Sequence
  Synthesized adaptor oligonucleotide
  misc_feature (34)..(36): n is a, c, g, or t
tgcaggaccagagaattcgaatacaccttgagannnacgtatgcca

SEQ ID NO: 1014 - DNA, 46 bp, Artificial Sequence
  Synthesized adaptor oligonucleotide
  misc_feature (34)..(36): n is a, c, g, or t
tgcaggaccagagaattcgaatacaacgctcttnnnacgtatgcca

SEQ ID NO: 1015 - DNA, 46 bp, Artificial Sequence
  Synthesized adaptor oligonucleotide
  misc_feature (34)..(36): n is a, c, g, or t
tgcaggaccagagaattcgaatacacacgaagannnacgtatgcca

SEQ ID NO: 1016 - DNA, 46 bp, Artificial Sequence
  Synthesized adaptor oligonucleotide
  misc_feature (34)..(36): n is a, c, g, or t
tgcaggaccagagaattcgaatacaggccacacnnnacgtatgcca

SEQ ID NO: 1017 - DNA, 46 bp, Artificial Sequence
  Synthesized adaptor oligonucleotide
  misc_feature (34)..(36): n is a, c, g, or t
tgcaggaccagagaattcgaatacatctgtgagnnnacgtatgcca

SEQ ID NO: 1018 - DNA, 46 bp, Artificial Sequence
  Synthesized adaptor oligonucleotide
  misc_feature (34)..(36): n is a, c, g, or t
tgcaggaccagagaattcgaatacaaaagccagnnnacgtatgcca

SEQ ID NO: 1019 - DNA, 46 bp, Artificial Sequence
  Synthesized adaptor oligonucleotide
  misc_feature (34)..(36): n is a, c, g, or t
tgcaggaccagagaattcgaatacaccagttgannnacgtatgcca

SEQ ID NO: 1020 - DNA, 46 bp, Artificial Sequence
  Synthesized adaptor oligonucleotide
  misc_feature (34)..(36): n is a, c, g, or t
tgcaggaccagagaattcgaatacacttgtaggnnnacgtatgcca

SEQ ID NO: 1021 - DNA, 46 bp, Artificial Sequence
  Synthesized adaptor oligonucleotide
  misc_feature (34)..(36): n is a, c, g, or t
tgcaggaccagagaattcgaatacaatatgcatnnnacgtatgcca

SEQ ID NO: 1022 - DNA, 46 bp, Artificial Sequence
  Synthesized adaptor oligonucleotide
  misc_feature (34)..(36): n is a, c, g, or t
tgcaggaccagagaattcgaatacaccaggcgtnnnacgtatgcca

SEQ ID NO: 1023 - DNA, 46 bp, Artificial Sequence
  Synthesized adaptor oligonucleotide
  misc_feature (34)..(36): n is a, c, g, or t
tgcaggaccagagaattcgaatacaatgtttagnnnacgtatgcca

SEQ ID NO: 1024 - DNA, 46 bp, Artificial Sequence
  Synthesized adaptor oligonucleotide
  misc_feature (34)..(36): n is a, c, g, or t
tgcaggaccagagaattcgaatacactgtccgcnnnacgtatgcca

SEQ ID NO: 1025 - DNA, 46 bp, Artificial Sequence
  Synthesized adaptor oligonucleotide
  misc_feature (34)..(36): n is a, c, g, or t
tgcaggaccagagaattcgaatacattttaccannnacgtatgcca

SEQ ID NO: 1026 - DNA, 46 bp, Artificial Sequence
  Synthesized adaptor oligonucleotide
  misc_feature (34)..(36): n is a, c, g, or t
tgcaggaccagagaattcgaatacatgccctgcnnnacgtatgcca

SEQ ID NO: 1027 - DNA, 46 bp, Artificial Sequence
  Synthesized adaptor oligonucleotide
  misc_feature (34)..(36): n is a, c, g, or t
tgcaggaccagagaattcgaatacacctttgacnnnacgtatgcca

SEQ ID NO: 1028 - DNA, 46 bp, Artificial Sequence
  Synthesized adaptor oligonucleotide
  misc_feature (34)..(36): n is a, c, g, or t
tgcaggaccagagaattcgaatacaattattttnnnacgtatgcca

SEQ ID NO: 1029 - DNA, 46 bp, Artificial Sequence
  Synthesized adaptor oligonucleotide
  misc_feature (34)..(36): n is a, c, g, or t
tgcaggaccagagaattcgaatacagtgtggaannnctagcgttac

SEQ ID NO: 1030 - DNA, 46 bp, Artificial Sequence
  Synthesized adaptor oligonucleotide
  misc_feature (34)..(36): n is a, c, g, or t
tgcaggaccagagaattcgaatacaactcgtagnnnctagcgttac

SEQ ID NO: 1031 - DNA, 46 bp, Artificial Sequence
  Synthesized adaptor oligonucleotide
  misc_feature (34)..(36): n is a, c, g, or t
tgcaggaccagagaattcgaatacatcgcgtccnnnctagcgttac

SEQ ID NO: 1032 - DNA, 46 bp, Artificial Sequence
  Synthesized adaptor oligonucleotide
  misc_feature (34)..(36): n is a, c, g, or t
tgcaggaccagagaattcgaatacagcctaatgnnnctagcgttac

SEQ ID NO: 1033 - DNA, 46 bp, Artificial Sequence
  Synthesized adaptor oligonucleotide
  misc_feature (34)..(36): n is a, c, g, or t
tgcaggaccagagaattcgaatacagcgtgttannnctagcgttac

SEQ ID NO: 1034 - DNA, 46 bp, Artificial Sequence
  Synthesized adaptor oligonucleotide
  misc_feature (34)..(36): n is a, c, g, or t
tgcaggaccagagaattcgaatacacgagaaacnnnctagcgttac

SEQ ID NO: 1035 - DNA, 46 bp, Artificial Sequence
  Synthesized adaptor oligonucleotide
  misc_feature (34)..(36): n is a, c, g, or t
tgcaggaccagagaattcgaatacaatgctcagnnnctagcgttac

SEQ ID NO: 1036 - DNA, 46 bp, Artificial Sequence
  Synthesized adaptor oligonucleotide
  misc_feature (34)..(36): n is a, c, g, or t
tgcaggaccagagaattcgaatacagtcagctannnctagcgttac

SEQ ID NO: 1037 - DNA, 46 bp, Artificial Sequence
  Synthesized adaptor oligonucleotide
  misc_feature (34)..(36): n is a, c, g, or t
tgcaggaccagagaattcgaatacaggtagcggnnnctagcgttac

SEQ ID NO: 1038 - DNA, 46 bp, Artificial Sequence
  Synthesized adaptor oligonucleotide
  misc_feature (34)..(36): n is a, c, g, or t
tgcaggaccagagaattcgaatacacctggtccnnnctagcgttac

SEQ ID NO: 1039 - DNA, 46 bp, Artificial Sequence
  Synthesized adaptor oligonucleotide
  misc_feature (34)..(36): n is a, c, g, or t
tgcaggaccagagaattcgaatacacagcaccgnnnctagcgttac

SEQ ID NO: 1040 - DNA, 46 bp, Artificial Sequence
  Synthesized adaptor oligonucleotide
  misc_feature (34)..(36): n is a, c, g, or t
tgcaggaccagagaattcgaatacacattgtggnnnctagcgttac

SEQ ID NO: 1041 - DNA, 46 bp, Artificial Sequence
  Synthesized adaptor oligonucleotide
  misc_feature (34)..(36): n is a, c, g, or t
tgcaggaccagagaattcgaatacaaggaactgnnnctagcgttac

SEQ ID NO: 1042 - DNA, 46 bp, Artificial Sequence
  Synthesized adaptor oligonucleotide
  misc_feature (34)..(36): n is a, c, g, or t
tgcaggaccagagaattcgaatacagttattagnnnctagcgttac

SEQ ID NO: 1043 - DNA, 46 bp, Artificial Sequence
  Synthesized adaptor oligonucleotide
  misc_feature (34)..(36): n is a, c, g, or t
tgcaggaccagagaattcgaatacaaatcttctnnnctagcgttac

SEQ ID NO: 1044 - DNA, 46 bp, Artificial Sequence
  Synthesized adaptor oligonucleotide
  misc_feature (34)..(36): n is a, c, g, or t
tgcaggaccagagaattcgaatacagacaatccnnnctagcgttac

SEQ ID NO: 1045 - DNA, 46 bp, Artificial Sequence
  Synthesized adaptor oligonucleotide
  misc_feature (34)..(36): n is a, c, g, or t
tgcaggaccagagaattcgaatacaatctagatnnnctagcgttac

SEQ ID NO: 1046 - DNA, 46 bp, Artificial Sequence
  Synthesized adaptor oligonucleotide
  misc_feature (34)..(36): n is a, c, g, or t
tgcaggaccagagaattcgaatacagcgacgtcnnnctagcgttac

SEQ ID NO: 1047 - DNA, 46 bp, Artificial Sequence
  Synthesized adaptor oligonucleotide
  misc_feature (34)..(36): n is a, c, g, or t
tgcaggaccagagaattcgaatacacaccccgtnnnctagcgttac

SEQ ID NO: 1048 - DNA, 46 bp, Artificial Sequence
  Synthesized adaptor oligonucleotide
  misc_feature (34)..(36): n is a, c, g, or t
tgcaggaccagagaattcgaatacacgcctcgtnnnctagcgttac

SEQ ID NO: 1049 - DNA, 46 bp, Artificial Sequence
  Synthesized adaptor oligonucleotide
  misc_feature (34)..(36): n is a, c, g, or t
tgcaggaccagagaattcgaatacactgacacannnctagcgttac

SEQ ID NO: 1050 - DNA, 46 bp, Artificial Sequence
  Synthesized adaptor oligonucleotide
  misc_feature (34)..(36): n is a, c, g, or t
tgcaggaccagagaattcgaatacatgctttgcnnnctagcgttac

SEQ ID NO: 1051 - DNA, 46 bp, Artificial Sequence
  Synthesized adaptor oligonucleotide
  misc_feature (34)..(36): n is a, c, g, or t
tgcaggaccagagaattcgaatacaactgtctcnnnctagcgttac

SEQ ID NO: 1052 - DNA, 46 bp, Artificial Sequence
  Synthesized adaptor oligonucleotide
  misc_feature (34)..(36): n is a, c, g, or t
tgcaggaccagagaattcgaatacatattgtctnnnctagcgttac

SEQ ID NO: 1053 - DNA, 46 bp, Artificial Sequence
  Synthesized adaptor oligonucleotide
  misc_feature (34)..(36): n is a, c, g, or t
tgcaggaccagagaattcgaatacaatttgacannnctagcgttac

SEQ ID NO: 1054 - DNA, 46 bp, Artificial Sequence
  Synthesized adaptor oligonucleotide
  misc_feature (34)..(36): n is a, c, g, or t
tgcaggaccagagaattcgaatacacgcacacgnnnctagcgttac

SEQ ID NO: 1055 - DNA, 46 bp, Artificial Sequence
  Synthesized adaptor oligonucleotide
  misc_feature (34)..(36): n is a, c, g, or t
tgcaggaccagagaattcgaatacaccgcgaacnnnctagcgttac

SEQ ID NO: 1056 - DNA, 46 bp, Artificial Sequence
  Synthesized adaptor oligonucleotide
  misc_feature (34)..(36): n is a, c, g, or t
tgcaggaccagagaattcgaatacattaggcgtnnnctagcgttac

SEQ ID NO: 1057 - DNA, 46 bp, Artificial Sequence
  Synthesized adaptor oligonucleotide
  misc_feature (34)..(36): n is a, c, g, or t
tgcaggaccagagaattcgaatacatcggagccnnnctagcgttac

SEQ ID NO: 1058 - DNA, 46 bp, Artificial Sequence
  Synthesized adaptor oligonucleotide
  misc_feature (34)..(36): n is a, c, g, or t
tgcaggaccagagaattcgaatacagtctacagnnnctagcgttac

SEQ ID NO: 1059 - DNA, 46 bp, Artificial Sequence
  Synthesized adaptor oligonucleotide
  misc_feature (34)..(36): n is a, c, g, or t
tgcaggaccagagaattcgaatacaccgcgtctnnnctagcgttac

SEQ ID NO: 1060 - DNA, 46 bp, Artificial Sequence
  Synthesized adaptor oligonucleotide
  misc_feature (34)..(36): n is a, c, g, or t
tgcaggaccagagaattcgaatacattaaactgnnnctagcgttac

SEQ ID NO: 1061 - DNA, 46 bp, Artificial Sequence
  Synthesized adaptor oligonucleotide
  misc_feature (34)..(36): n is a, c, g, or t
tgcaggaccagagaattcgaatacaataagaacnnnctagcgttac

SEQ ID NO: 1062 - DNA, 46 bp, Artificial Sequence
  Synthesized adaptor oligonucleotide
  misc_feature (34)..(36): n is a, c, g, or t
tgcaggaccagagaattcgaatacaatcatgcgnnnctagcgttac

SEQ ID NO: 1063 - DNA, 46 bp, Artificial Sequence
  Synthesized adaptor oligonucleotide
  misc_feature (34)..(36): n is a, c, g, or t
tgcaggaccagagaattcgaatacaccaactagnnnctagcgttac

SEQ ID NO: 1064 - DNA, 46 bp, Artificial Sequence
  Synthesized adaptor oligonucleotide
  misc_feature (34)..(36): n is a, c, g, or t
tgcaggaccagagaattcgaatacactcgagtannnctagcgttac

SEQ ID NO: 1065 - DNA, 46 bp, Artificial Sequence
  Synthesized adaptor oligonucleotide
  misc_feature (34)..(36): n is a, c, g, or t
tgcaggaccagagaattcgaatacactttgccannnctagcgttac

SEQ ID NO: 1066 - DNA, 46 bp, Artificial Sequence
  Synthesized adaptor oligonucleotide
  misc_feature (34)..(36): n is a, c, g, or t
tgcaggaccagagaattcgaatacaaattctgannnctagcgttac

SEQ ID NO: 1067 - DNA, 46 bp, Artificial Sequence
  Synthesized adaptor oligonucleotide
  misc_feature (34)..(36): n is a, c, g, or t
tgcaggaccagagaattcgaatacagatcgcatnnnctagcgttac

SEQ ID NO: 1068 - DNA, 46 bp, Artificial Sequence
  Synthesized adaptor oligonucleotide
  misc_feature (34)..(36): n is a, c, g, or t
tgcaggaccagagaattcgaatacatgtgttggnnnctagcgttac

SEQ ID NO: 1069 - DNA, 46 bp, Artificial Sequence
  Synthesized adaptor oligonucleotide
  misc_feature (34)..(36): n is a, c, g, or t
tgcaggaccagagaattcgaatacagtaacattnnnctagcgttac

SEQ ID NO: 1070 - DNA, 46 bp, Artificial Sequence
  Synthesized adaptor oligonucleotide
  misc_feature (34)..(36): n is a, c, g, or t
tgcaggaccagagaattcgaatacaacgcatcannnctagcgttac

SEQ ID NO: 1071 - DNA, 46 bp, Artificial Sequence
  Synthesized adaptor oligonucleotide
  misc_feature (34)..(36): n is a, c, g, or t
tgcaggaccagagaattcgaatacataggaagcnnnctagcgttac

SEQ ID NO: 1072 - DNA, 46 bp, Artificial Sequence
  Synthesized adaptor oligonucleotide
  misc_feature (34)..(36): n is a, c, g, or t
tgcaggaccagagaattcgaatacagcaatgtcnnnctagcgttac

SEQ ID NO: 1073 - DNA, 46 bp, Artificial Sequence
  Synthesized adaptor oligonucleotide
  misc_feature (34)..(36): n is a, c, g, or t
tgcaggaccagagaattcgaatacagccggcatnnnctagcgttac

SEQ ID NO: 1074 - DNA, 46 bp, Artificial Sequence
  Synthesized adaptor oligonucleotide
  misc_feature (34)..(36): n is a, c, g, or t
tgcaggaccagagaattcgaatacactgagcgcnnnctagcgttac

SEQ ID NO: 1075 - DNA, 46 bp, Artificial Sequence
  Synthesized adaptor oligonucleotide
  misc_feature (34)..(36): n is a, c, g, or t
tgcaggaccagagaattcgaatacactgctgccnnnctagcgttac

SEQ ID NO: 1076 - DNA, 46 bp, Artificial Sequence
  Synthesized adaptor oligonucleotide
  misc_feature (34)..(36): n is a, c, g, or t
tgcaggaccagagaattcgaatacagtggcggannnctagcgttac

SEQ ID NO: 1077 - DNA, 46 bp, Artificial Sequence
  Synthesized adaptor oligonucleotide
  misc_feature (34)..(36): n is a, c, g, or t
tgcaggaccagagaattcgaatacaaggctactnnnctagcgttac

SEQ ID NO: 1078 - DNA, 46 bp, Artificial Sequence
  Synthesized adaptor oligonucleotide
  misc_feature (34)..(36): n is a, c, g, or t
tgcaggaccagagaattcgaatacaactttgttnnnctagcgttac

SEQ ID NO: 1079 - DNA, 46 bp, Artificial Sequence
  Synthesized adaptor oligonucleotide
  misc_feature (34)..(36): n is a, c, g, or t
tgcaggaccagagaattcgaatacagccatatgnnnctagcgttac

SEQ ID NO: 1080 - DNA, 46 bp, Artificial Sequence
  Synthesized adaptor oligonucleotide
  misc_feature (34)..(36): n is a, c, g, or t
tgcaggaccagagaattcgaatacaagcctggcnnnctagcgttac

SEQ ID NO: 1081 - DNA, 46 bp, Artificial Sequence
  Synthesized adaptor oligonucleotide
  misc_feature (34)..(36): n is a, c, g, or t
tgcaggaccagagaattcgaatacaacgtgtgtnnnctagcgttac

SEQ ID NO: 1082 - DNA, 46 bp, Artificial Sequence
  Synthesized adaptor oligonucleotide
  misc_feature (34)..(36): n is a, c, g, or t
tgcaggaccagagaattcgaatacattttcatgnnnctagcgttac

SEQ ID NO: 1083 - DNA, 46 bp, Artificial Sequence
  Synthesized adaptor oligonucleotide
  misc_feature (34)..(36): n is a, c, g, or t
tgcaggaccagagaattcgaatacagctgcgacnnnctagcgttac

SEQ ID NO: 1084 - DNA, 46 bp, Artificial Sequence
  Synthesized adaptor oligonucleotide
  misc_feature (34)..(36): n is a, c, g, or t
tgcaggaccagagaattcgaatacacaaaatagnnnctagcgttac

SEQ ID NO: 1085 - DNA, 46 bp, Artificial Sequence
  Synthesized adaptor oligonucleotide
  misc_feature (34)..(36): n is a, c, g, or t
tgcaggaccagagaattcgaatacactaaactannnctagcgttac

SEQ ID NO: 1086 - DNA, 46 bp, Artificial Sequence
  Synthesized adaptor oligonucleotide
  misc_feature (34)..(36): n is a, c, g, or t
tgcaggaccagagaattcgaatacaaaatgatgnnnctagcgttac

SEQ ID NO: 1087 - DNA, 46 bp, Artificial Sequence
  Synthesized adaptor oligonucleotide
  misc_feature (34)..(36): n is a, c, g, or t
tgcaggaccagagaattcgaatacacttgcttgnnnctagcgttac

SEQ ID NO: 1088 - DNA, 46 bp, Artificial Sequence
  Synthesized adaptor oligonucleotide
  misc_feature (34)..(36): n is a, c, g, or t
tgcaggaccagagaattcgaatacagataggcannnctagcgttac

SEQ ID NO: 1089 - DNA, 46 bp, Artificial Sequence
  Synthesized adaptor oligonucleotide
  misc_feature (34)..(36): n is a, c, g, or t
tgcaggaccagagaattcgaatacacagattatnnngatcgacatg

SEQ ID NO: 1090 - DNA, 46 bp, Artificial Sequence
  Synthesized adaptor oligonucleotide
  misc_feature (34)..(36): n is a, c, g, or t
tgcaggaccagagaattcgaatacagttacggtnnngatcgacatg

SEQ ID NO: 1091 - DNA, 46 bp, Artificial Sequence
  Synthesized adaptor oligonucleotide
  misc_feature (34)..(36): n is a, c, g, or t
tgcaggaccagagaattcgaatacaacagttgcnnngatcgacatg

SEQ ID NO: 1092 - DNA, 46 bp, Artificial Sequence
  Synthesized adaptor oligonucleotide
  misc_feature (34)..(36): n is a, c, g, or t
tgcaggaccagagaattcgaatacaaactgcacnnngatcgacatg

SEQ ID NO: 1093 - DNA, 46 bp, Artificial Sequence
  Synthesized adaptor oligonucleotide
  misc_feature (34)..(36): n is a, c, g, or t
tgcaggaccagagaattcgaatacaagaatatgnnngatcgacatg

SEQ ID NO: 1094 - DNA, 46 bp, Artificial Sequence
  Synthesized adaptor oligonucleotide
  misc_feature (34)..(36): n is a, c, g, or t
tgcaggaccagagaattcgaatacatcgtcctannngatcgacatg

SEQ ID NO: 1095 - DNA, 46 bp, Artificial Sequence
  Synthesized adaptor oligonucleotide
  misc_feature (34)..(36): n is a, c, g, or t
tgcaggaccagagaattcgaatacacagaatccnnngatcgacatg

SEQ ID NO: 1096 - DNA, 46 bp, Artificial Sequence
  Synthesized adaptor oligonucleotide
  misc_feature (34)..(36): n is a, c, g, or t
tgcaggaccagagaattcgaatacacttgacagnnngatcgacatg

SEQ ID NO: 1097 - DNA, 46 bp, Artificial Sequence
  Synthesized adaptor oligonucleotide
  misc_feature (34)..(36): n is a, c, g, or t
tgcaggaccagagaattcgaatacactggtagtnnngatcgacatg

SEQ ID NO: 1098 - DNA, 46 bp, Artificial Sequence
  Synthesized adaptor oligonucleotide
  misc_feature (34)..(36): n is a, c, g, or t
tgcaggaccagagaattcgaatacacggatctannngatcgacatg

SEQ ID NO: 1099 - DNA, 46 bp, Artificial Sequence
  Synthesized adaptor oligonucleotide
  misc_feature (34)..(36): n is a, c, g, or t
tgcaggaccagagaattcgaatacaaaaaagagnnngatcgacatg

SEQ ID NO: 1100 - DNA, 46 bp, Artificial Sequence
  Synthesized adaptor oligonucleotide
  misc_feature (34)..(36): n is a, c, g, or t
tgcaggaccagagaattcgaatacaggagacatnnngatcgacatg

SEQ ID NO: 1101 - DNA, 46 bp, Artificial Sequence
  Synthesized adaptor oligonucleotide
  misc_feature (34)..(36): n is a, c, g, or t
tgcaggaccagagaattcgaatacatccggagcnnngatcgacatg

SEQ ID NO: 1102 - DNA, 46 bp, Artificial Sequence
  Synthesized adaptor oligonucleotide
  misc_feature (34)..(36): n is a, c, g, or t
tgcaggaccagagaattcgaatacatgttattcnnngatcgacatg

SEQ ID NO: 1103 - DNA, 46 bp, Artificial Sequence
  Synthesized adaptor oligonucleotide
  misc_feature (34)..(36): n is a, c, g, or t
tgcaggaccagagaattcgaatacagcgagacgnnngatcgacatg

SEQ ID NO: 1104 - DNA, 46 bp, Artificial Sequence
  Synthesized adaptor oligonucleotide
  misc_feature (34)..(36): n is a, c, g, or t
tgcaggaccagagaattcgaatacattatcgaannngatcgacatg

SEQ ID NO: 1105 - DNA, 46 bp, Artificial Sequence
  Synthesized adaptor oligonucleotide
  misc_feature (34)..(36): n is a, c, g, or t
tgcaggaccagagaattcgaatacagtgccaatnnngatcgacatg

SEQ ID NO: 1106 - DNA, 46 bp, Artificial Sequence
  Synthesized adaptor oligonucleotide
  misc_feature (34)..(36): n is a, c, g, or t
tgcaggaccagagaattcgaatacagctaaaaannngatcgacatg

SEQ ID NO: 1107 - DNA, 46 bp, Artificial Sequence
  Synthesized adaptor oligonucleotide
  misc_feature (34)..(36): n is a, c, g, or t
tgcaggaccagagaattcgaatacaatccaatannngatcgacatg

SEQ ID NO: 1108 - DNA, 46 bp, Artificial Sequence
  Synthesized adaptor oligonucleotide
  misc_feature (34)..(36): n is a, c, g, or t
tgcaggaccagagaattcgaatacattcaaggcnnngatcgacatg

SEQ ID NO: 1109 - DNA, 46 bp, Artificial Sequence
  Synthesized adaptor oligonucleotide
  misc_feature (34)..(36): n is a, c, g, or t
tgcaggaccagagaattcgaatacattattaaannngatcgacatg

SEQ ID NO: 1110 - DNA, 46 bp, Artificial Sequence
  Synthesized adaptor oligonucleotide
  misc_feature (34)..(36): n is a, c, g, or t
tgcaggaccagagaattcgaatacaaactctaannngatcgacatg

SEQ ID NO: 1111 - DNA, 46 bp, Artificial Sequence
  Synthesized adaptor oligonucleotide
  misc_feature (34)..(36): n is a, c, g, or t
tgcaggaccagagaattcgaatacagactccaannngatcgacatg

SEQ ID NO: 1112 - DNA, 46 bp, Artificial Sequence
  Synthesized adaptor oligonucleotide
  misc_feature (34)..(36): n is a, c, g, or t
tgcaggaccagagaattcgaatacacagcctccnnngatcgacatg

SEQ ID NO: 1113 - DNA, 46 bp, Artificial Sequence
  Synthesized adaptor oligonucleotide
  misc_feature (34)..(36): n is a, c, g, or t
tgcaggaccagagaattcgaatacagagtcactnnngatcgacatg

SEQ ID NO: 1114 - DNA, 46 bp, Artificial Sequence
  Synthesized adaptor oligonucleotide
  misc_feature (34)..(36): n is a, c, g, or t
tgcaggaccagagaattcgaatacaagaactggnnngatcgacatg

SEQ ID NO: 1115 - DNA, 46 bp, Artificial Sequence
  Synthesized adaptor oligonucleotide
  misc_feature (34)..(36): n is a, c, g, or t
tgcaggaccagagaattcgaatacagcgtattgnnngatcgacatg

SEQ ID NO: 1116 - DNA, 46 bp, Artificial Sequence
  Synthesized adaptor oligonucleotide
  misc_feature (34)..(36): n is a, c, g, or t
tgcaggaccagagaattcgaatacacttaaatgnnngatcgacatg

SEQ ID NO: 1117 - DNA, 46 bp, Artificial Sequence
  Synthesized adaptor oligonucleotide
  misc_feature (34)..(36): n is a, c, g, or t
tgcaggaccagagaattcgaatacattagcctcnnngatcgacatg

SEQ ID NO: 1118 - DNA, 46 bp, Artificial Sequence
  Synthesized adaptor oligonucleotide
  misc_feature (34)..(36): n is a, c, g, or t
tgcaggaccagagaattcgaatacaaccagagannngatcgacatg

SEQ ID NO: 1119 - DNA, 46 bp, Artificial Sequence
  Synthesized adaptor oligonucleotide
  misc_feature (34)..(36): n is a, c, g, or t
tgcaggaccagagaattcgaatacatcagccaannngatcgacatg

SEQ ID NO: 1120 - DNA, 46 bp, Artificial Sequence
  Synthesized adaptor oligonucleotide
  misc_feature (34)..(36): n is a, c, g, or t
tgcaggaccagagaattcgaatacaccgaatacnnngatcgacatg

SEQ ID NO: 1121 - DNA, 46 bp, Artificial Sequence
  Synthesized adaptor oligonucleotide
  misc_feature (34)..(36): n is a, c, g, or t
tgcaggaccagagaattcgaatacagcggcaagnnngatcgacatg

SEQ ID NO: 1122 - DNA, 46 bp, Artificial Sequence
  Synthesized adaptor oligonucleotide
  misc_feature (34)..(36): n is a, c, g, or t
tgcaggaccagagaattcgaatacataaatcgtnnngatcgacatg

SEQ ID NO: 1123 - DNA, 46 bp, Artificial Sequence
  Synthesized adaptor oligonucleotide
  misc_feature (34)..(36): n is a, c, g, or t
tgcaggaccagagaattcgaatacaaagcttcgnnngatcgacatg

SEQ ID NO: 1124 - DNA, 46 bp, Artificial Sequence
  Synthesized adaptor oligonucleotide
  misc_feature (34)..(36): n is a, c, g, or t
tgcaggaccagagaattcgaatacaatgcatatnnngatcgacatg

SEQ ID NO: 1125 - DNA, 46 bp, Artificial Sequence
  Synthesized adaptor oligonucleotide
  misc_feature (34)..(36): n is a, c, g, or t
tgcaggaccagagaattcgaatacatctctcctnnngatcgacatg

SEQ ID NO: 1126 - DNA, 46 bp, Artificial Sequence
  Synthesized adaptor oligonucleotide
  misc_feature (34)..(36): n is a, c, g, or t
tgcaggaccagagaattcgaatacatagtggtcnnngatcgacatg

SEQ ID NO: 1127 - DNA, 46 bp, Artificial Sequence
  Synthesized adaptor oligonucleotide
  misc_feature (34)..(36): n is a, c, g, or t
tgcaggaccagagaattcgaatacagaaacctcnnngatcgacatg

SEQ ID NO: 1128 - DNA, 46 bp, Artificial Sequence
  Synthesized adaptor oligonucleotide
  misc_feature (34)..(36): n is a, c, g, or t
tgcaggaccagagaattcgaatacatgactatannngatcgacatg

SEQ ID NO: 1129 - DNA, 46 bp, Artificial Sequence
  Synthesized adaptor oligonucleotide
  misc_feature (34)..(36): n is a, c, g, or t
tgcaggaccagagaattcgaatacacatgactgnnngatcgacatg

SEQ ID NO: 1130 - DNA, 46 bp, Artificial Sequence
  Synthesized adaptor oligonucleotide
  misc_feature (34)..(36): n is a, c, g, or t
tgcaggaccagagaattcgaatacaccaaagtcnnngatcgacatg

SEQ ID NO: 1131 - DNA, 46 bp, Artificial Sequence
  Synthesized adaptor oligonucleotide
  misc_feature (34)..(36): n is a, c, g, or t
tgcaggaccagagaattcgaatacacgcatttcnnngatcgacatg

SEQ ID NO: 1132 - DNA, 46 bp, Artificial Sequence
  Synthesized adaptor oligonucleotide
  misc_feature (34)..(36): n is a, c, g, or t
tgcaggaccagagaattcgaatacaacccggtgnnngatcgacatg

SEQ ID NO: 1133 - DNA, 46 bp, Artificial Sequence
  Synthesized adaptor oligonucleotide
  misc_feature (34)..(36): n is a, c, g, or t
tgcaggaccagagaattcgaatacacttgcgttnnngatcgacatg

SEQ ID NO: 1134 - DNA, 46 bp, Artificial Sequence
  Synthesized adaptor oligonucleotide
  misc_feature (34)..(36): n is a, c, g, or t
tgcaggaccagagaattcgaatacattatgcaannngatcgacatg

SEQ ID NO: 1135 - DNA, 46 bp, Artificial Sequence
  Synthesized adaptor oligonucleotide
  misc_feature (34)..(36): n is a, c, g, or t
tgcaggaccagagaattcgaatacatatttgagnnngatcgacatg

SEQ ID NO: 1136 - DNA, 46 bp, Artificial Sequence
  Synthesized adaptor oligonucleotide
  misc_feature (34)..(36): n is a, c, g, or t
tgcaggaccagagaattcgaatacatgttcgctnnngatcgacatg

SEQ ID NO: 1137 - DNA, 46 bp, Artificial Sequence
  Synthesized adaptor oligonucleotide
  misc_feature (34)..(36): n is a, c, g, or t
tgcaggaccagagaattcgaatacatagcatcgnnngatcgacatg

SEQ ID NO: 1138 - DNA, 46 bp, Artificial Sequence
  Synthesized adaptor oligonucleotide
  misc_feature (34)..(36): n is a, c, g, or t
tgcaggaccagagaattcgaatacattcagagcnnngatcgacatg

SEQ ID NO: 1139 - DNA, 46 bp, Artificial Sequence
  Synthesized adaptor oligonucleotide
  misc_feature (34)..(36): n is a, c, g, or t
tgcaggaccagagaattcgaatacaaacgcagannngatcgacatg

SEQ ID NO: 1140 - DNA, 46 bp, Artificial Sequence
  Synthesized adaptor oligonucleotide
  misc_feature (34)..(36): n is a, c, g, or t
tgcaggaccagagaattcgaatacatatggcgtnnngatcgacatg

SEQ ID NO: 1141 - DNA, 46 bp, Artificial Sequence
  Synthesized adaptor oligonucleotide
  misc_feature (34)..(36): n is a, c, g, or t
tgcaggaccagagaattcgaatacaagcctatgnnngatcgacatg

SEQ ID NO: 1142 - DNA, 46 bp, Artificial Sequence
  Synthesized adaptor oligonucleotide
  misc_feature (34)..(36): n is a, c, g, or t
tgcaggaccagagaattcgaatacacactctacnnngatcgacatg

SEQ ID NO: 1143 - DNA, 46 bp, Artificial Sequence
  Synthesized adaptor oligonucleotide
  misc_feature (34)..(36): n is a, c, g, or t
tgcaggaccagagaattcgaatacaaaactgaannngatcgacatg

SEQ ID NO: 1144 - DNA, 46 bp, Artificial Sequence
  Synthesized adaptor oligonucleotide
  misc_feature (34)..(36): n is a, c, g, or t
tgcaggaccagagaattcgaatacacttccgcgnnngatcgacatg

SEQ ID NO: 1145 - DNA, 46 bp, Artificial Sequence
  Synthesized adaptor oligonucleotide
  misc_feature (34)..(36): n is a, c, g, or t
tgcaggaccagagaattcgaatacaacgtcggcnnngatcgacatg

SEQ ID NO: 1146 - DNA, 46 bp, Artificial Sequence
  Synthesized adaptor oligonucleotide
  misc_feature (34)..(36): n is a, c, g, or t
tgcaggaccagagaattcgaatacagtacccaannngatcgacatg

SEQ ID NO: 1147 - DNA, 46 bp, Artificial Sequence
  Synthesized adaptor oligonucleotide
  misc_feature (34)..(36): n is a, c, g, or t
tgcaggaccagagaattcgaatacaaccgcatannngatcgacatg

SEQ ID NO: 1148 - DNA, 46 bp, Artificial Sequence
  Synthesized adaptor oligonucleotide
  misc_feature (34)..(36): n is a, c, g, or t
tgcaggaccagagaattcgaatacaaaccagctnnngatcgacatg

SEQ ID NO: 1149 - DNA, 46 bp, Artificial Sequence
  Synthesized adaptor oligonucleotide
  misc_feature (34)..(36): n is a, c, g, or t
tgcaggaccagagaattcgaatacagagcgagcnnntgcatcaggt

SEQ ID NO: 1150 - DNA, 46 bp, Artificial Sequence
  Synthesized adaptor oligonucleotide
  misc_feature (34)..(36): n is a, c, g, or t
tgcaggaccagagaattcgaatacattttattannntgcatcaggt

SEQ ID NO: 1151 - DNA, 46 bp, Artificial Sequence
  Synthesized adaptor oligonucleotide
  misc_feature (34)..(36): n is a, c, g, or t
tgcaggaccagagaattcgaatacagctaggttnnntgcatcaggt

SEQ ID NO: 1152 - DNA, 46 bp, Artificial Sequence
  Synthesized adaptor oligonucleotide
  misc_feature (34)..(36): n is a, c, g, or t
tgcaggaccagagaattcgaatacatttgacttnnntgcatcaggt

SEQ ID NO: 1153 - DNA, 46 bp, Artificial Sequence
  Synthesized adaptor oligonucleotide
  misc_feature (34)..(36): n is a, c, g, or t
tgcaggaccagagaattcgaatacacaaacattnnntgcatcaggt

SEQ ID NO: 1154 - DNA, 46 bp, Artificial Sequence
  Synthesized adaptor oligonucleotide
  misc_feature (34)..(36): n is a, c, g, or t
tgcaggaccagagaattcgaatacattgcaatannntgcatcaggt

SEQ ID NO: 1155 - DNA, 46 bp, Artificial Sequence
  Synthesized adaptor oligonucleotide
  misc_feature (34)..(36): n is a, c, g, or t
tgcaggaccagagaattcgaatacaacaaggcannntgcatcaggt

SEQ ID NO: 1156 - DNA, 46 bp, Artificial Sequence
  Synthesized adaptor oligonucleotide
  misc_feature (34)..(36): n is a, c, g, or t
tgcaggaccagagaattcgaatacaggtgctgcnnntgcatcaggt

SEQ ID NO: 1157 - DNA, 46 bp, Artificial Sequence
  Synthesized adaptor oligonucleotide
  misc_feature (34)..(36): n is a, c, g, or t
tgcaggaccagagaattcgaatacaaggtcgttnnntgcatcaggt

SEQ ID NO: 1158 - DNA, 46 bp, Artificial Sequence
  Synthesized adaptor oligonucleotide
  misc_feature (34)..(36): n is a, c, g, or t
tgcaggaccagagaattcgaatacacaacggaannntgcatcaggt

SEQ ID NO: 1159 - DNA, 46 bp, Artificial Sequence
  Synthesized adaptor oligonucleotide
  misc_feature (34)..(36): n is a, c, g, or t
tgcaggaccagagaattcgaatacagatccaacnnntgcatcaggt

SEQ ID NO: 1160 - DNA, 46 bp, Artificial Sequence
  Synthesized adaptor oligonucleotide
  misc_feature (34)..(36): n is a, c, g, or t
tgcaggaccagagaattcgaatacaggaagactnnntgcatcaggt

SEQ ID NO: 1161 - DNA, 46 bp, Artificial Sequence
  Synthesized adaptor oligonucleotide
  misc_feature (34)..(36): n is a, c, g, or t
tgcaggaccagagaattcgaatacaggtaaatannntgcatcaggt

SEQ ID NO: 1162 - DNA, 46 bp, Artificial Sequence
  Synthesized adaptor oligonucleotide
  misc_feature (34)..(36): n is a, c, g, or t
tgcaggaccagagaattcgaatacaggtagaacnnntgcatcaggt

SEQ ID NO: 1163 - DNA, 46 bp, Artificial Sequence
  Synthesized adaptor oligonucleotide
  misc_feature (34)..(36): n is a, c, g, or t
tgcaggaccagagaattcgaatacaatatgagannntgcatcaggt

SEQ ID NO: 1164 - DNA, 46 bp, Artificial Sequence
  Synthesized adaptor oligonucleotide
  misc_feature (34)..(36): n is a, c, g, or t
tgcaggaccagagaattcgaatacatggaaatannntgcatcaggt

SEQ ID NO: 1165 - DNA, 46 bp, Artificial Sequence
  Synthesized adaptor oligonucleotide
  misc_feature (34)..(36): n is a, c, g, or t
tgcaggaccagagaattcgaatacataaccaatnnntgcatcaggt

SEQ ID NO: 1166 - DNA, 46 bp, Artificial Sequence
  Synthesized adaptor oligonucleotide
  misc_feature (34)..(36): n is a, c, g, or t
tgcaggaccagagaattcgaatacagtctgatgnnntgcatcaggt

SEQ ID NO: 1167 - DNA, 46 bp, Artificial Sequence
  Synthesized adaptor oligonucleotide
  misc_feature (34)..(36): n is a, c, g, or t
tgcaggaccagagaattcgaatacatttatgagnnntgcatcaggt

SEQ ID NO: 1168 - DNA, 46 bp, Artificial Sequence
  Synthesized adaptor oligonucleotide
  misc_feature (34)..(36): n is a, c, g, or t
tgcaggaccagagaattcgaatacaatgatttgnnntgcatcaggt

SEQ ID NO: 1169 - DNA, 46 bp, Artificial Sequence
  Synthesized adaptor oligonucleotide
  misc_feature (34)..(36): n is a, c, g, or t
tgcaggaccagagaattcgaatacactcatcgtnnntgcatcaggt

SEQ ID NO: 1170 - DNA, 46 bp, Artificial Sequence
  Synthesized adaptor oligonucleotide
  misc_feature (34)..(36): n is a, c, g, or t
tgcaggaccagagaattcgaatacactccatacnnntgcatcaggt

SEQ ID NO: 1171 - DNA, 46 bp, Artificial Sequence
  Synthesized adaptor oligonucleotide
  misc_feature (34)..(36): n is a, c, g, or t
tgcaggaccagagaattcgaatacagctagcatnnntgcatcaggt

SEQ ID NO: 1172 - DNA, 46 bp, Artificial Sequence
  Synthesized adaptor oligonucleotide
  misc_feature (34)..(36): n is a, c, g, or t
tgcaggaccagagaattcgaatacaaatcatcannntgcatcaggt

SEQ ID NO: 1173 - DNA, 46 bp, Artificial Sequence
  Synthesized adaptor oligonucleotide
  misc_feature (34)..(36): n is a, c, g, or t
tgcaggaccagagaattcgaatacacgtctcatnnntgcatcaggt

SEQ ID NO: 1174 - DNA, 46 bp, Artificial Sequence
  Synthesized adaptor oligonucleotide
  misc_feature (34)..(36): n is a, c, g, or t
tgcaggaccagagaattcgaatacaactcgttcnnntgcatcaggt

SEQ ID NO: 1175 - DNA, 46 bp, Artificial Sequence
  Synthesized adaptor oligonucleotide
  misc_feature (34)..(36): n is a, c, g, or t
tgcaggaccagagaattcgaatacaagttctggnnntgcatcaggt

SEQ ID NO: 1176 - DNA, 46 bp, Artificial Sequence
  Synthesized adaptor oligonucleotide
  misc_feature (34)..(36): n is a, c, g, or t
tgcaggaccagagaattcgaatacaactagtatnnntgcatcaggt

SEQ ID NO: 1177 - DNA, 46 bp, Artificial Sequence
  Synthesized adaptor oligonucleotide
  misc_feature (34)..(36): n is a, c, g, or t
tgcaggaccagagaattcgaatacaattgcgcannntgcatcaggt

SEQ ID NO: 1178 - DNA, 46 bp, Artificial Sequence
  Synthesized adaptor oligonucleotide
  misc_feature (34)..(36): n is a, c, g, or t
tgcaggaccagagaattcgaatacacgagcgctnnntgcatcaggt

SEQ ID NO: 1179 - DNA, 46 bp, Artificial Sequence
  Synthesized adaptor oligonucleotide
  misc_feature (34)..(36): n is a, c, g, or t
tgcaggaccagagaattcgaatacaacgaccatnnntgcatcaggt

SEQ ID NO: 1180 - DNA, 46 bp, Artificial Sequence
  Synthesized adaptor oligonucleotide
  misc_feature (34)..(36): n is a, c, g, or t
tgcaggaccagagaattcgaatacataagtgaannntgcatcaggt

SEQ ID NO: 1181 - DNA, 46 bp, Artificial Sequence
  Synthesized adaptor oligonucleotide
  misc_feature (34)..(36): n is a, c, g, or t
tgcaggaccagagaattcgaatacatctcgccgnnntgcatcaggt

SEQ ID NO: 1182 - DNA, 46 bp, Artificial Sequence
  Synthesized adaptor oligonucleotide
  misc_feature (34)..(36): n is a, c, g, or t
tgcaggaccagagaattcgaatacaaatactgtnnntgcatcaggt

SEQ ID NO: 1183 - DNA, 46 bp, Artificial Sequence
  Synthesized adaptor oligonucleotide
  misc_feature (34)..(36): n is a, c, g, or t
tgcaggaccagagaattcgaatacatatgttctnnntgcatcaggt

SEQ ID NO: 1184 - DNA, 46 bp, Artificial Sequence
  Synthesized adaptor oligonucleotide
  misc_feature (34)..(36): n is a, c, g, or t
tgcaggaccagagaattcgaatacaccagcggtnnntgcatcaggt

SEQ ID NO: 1185 - DNA, 46 bp, Artificial Sequence
  Synthesized adaptor oligonucleotide
  misc_feature (34)..(36): n is a, c, g, or t
tgcaggaccagagaattcgaatacacggttgatnnntgcatcaggt

SEQ ID NO: 1186 - DNA, 46 bp, Artificial Sequence
  Synthesized adaptor oligonucleotide
  misc_feature (34)..(36): n is a, c, g, or t
tgcaggaccagagaattcgaatacacgctgcagnnntgcatcaggt

SEQ ID NO: 1187 - DNA, 46 bp, Artificial Sequence
  Synthesized adaptor oligonucleotide
  misc_feature (34)..(36): n is a, c, g, or t
tgcaggaccagagaattcgaatacagtctaaatnnntgcatcaggt

SEQ ID NO: 1188 - DNA, 46 bp, Artificial Sequence
  Synthesized adaptor oligonucleotide
  misc_feature (34)..(36): n is a, c, g, or t
tgcaggaccagagaattcgaatacagtaattacnnntgcatcaggt

SEQ ID NO: 1189 - DNA, 46 bp, Artificial Sequence
  Synthesized adaptor oligonucleotide
  misc_feature (34)..(36): n is a, c, g, or t
tgcaggaccagagaattcgaatacattccggttnnntgcatcaggt

SEQ ID NO: 1190 - DNA, 46 bp, Artificial Sequence
  Synthesized adaptor oligonucleotide
  misc_feature (34)..(36): n is a, c, g, or t
tgcaggaccagagaattcgaatacagagcgtggnnntgcatcaggt

SEQ ID NO: 1191 - DNA, 46 bp, Artificial Sequence
  Synthesized adaptor oligonucleotide
  misc_feature (34)..(36): n is a, c, g, or t
tgcaggaccagagaattcgaatacaatttactcnnntgcatcaggt

SEQ ID NO: 1192 - DNA, 46 bp, Artificial Sequence
  Synthesized adaptor oligonucleotide
  misc_feature (34)..(36): n is a, c, g, or t
tgcaggaccagagaattcgaatacacaacactgnnntgcatcaggt

SEQ ID NO: 1193 - DNA, 46 bp, Artificial Sequence
  Synthesized adaptor oligonucleotide
  misc_feature (34)..(36): n is a, c, g, or t
tgcaggaccagagaattcgaatacaccgcggcgnnntgcatcaggt

SEQ ID NO: 1194 - DNA, 46 bp, Artificial Sequence
  Synthesized adaptor oligonucleotide
  misc_feature (34)..(36): n is a, c, g, or t
tgcaggaccagagaattcgaatacactaagctgnnntgcatcaggt

SEQ ID NO: 1195 - DNA, 46 bp, Artificial Sequence
  Synthesized adaptor oligonucleotide
  misc_feature (34)..(36): n is a, c, g, or t
tgcaggaccagagaattcgaatacaattcaagtnnntgcatcaggt

SEQ ID NO: 1196 - DNA, 46 bp, Artificial Sequence
  Synthesized adaptor oligonucleotide
  misc_feature (34)..(36): n is a, c, g, or t
tgcaggaccagagaattcgaatacaattggcgtnnntgcatcaggt

SEQ ID NO: 1197 - DNA, 46 bp, Artificial Sequence
  Synthesized adaptor oligonucleotide
  misc_feature (34)..(36): n is a, c, g, or t
tgcaggaccagagaattcgaatacatgatttgannntgcatcaggt

SEQ ID NO: 1198 - DNA, 46 bp, Artificial Sequence
  Synthesized adaptor oligonucleotide
  misc_feature (34)..(36): n is a, c, g, or t
tgcaggaccagagaattcgaatacaactgccggnnntgcatcaggt

SEQ ID NO: 1199 - DNA, 46 bp, Artificial Sequence
  Synthesized adaptor oligonucleotide
  misc_feature (34)..(36): n is a, c, g, or t
tgcaggaccagagaattcgaatacattaatcctnnntgcatcaggt

SEQ ID NO: 1200 - DNA, 46 bp, Artificial Sequence
  Synthesized adaptor oligonucleotide
  misc_feature (34)..(36): n is a, c, g, or t
tgcaggaccagagaattcgaatacactacgcttnnntgcatcaggt

SEQ ID NO: 1201 - DNA, 46 bp, Artificial Sequence
  Synthesized adaptor oligonucleotide
  misc_feature (34)..(36): n is a, c, g, or t
tgcaggaccagagaattcgaatacatagctatannntgcatcaggt

SEQ ID NO: 1202 - DNA, 46 bp, Artificial Sequence
  Synthesized adaptor oligonucleotide
  misc_feature (34)..(36): n is a, c, g, or t
tgcaggaccagagaattcgaatacatgcactctnnntgcatcaggt

SEQ ID NO: 1203 - DNA, 46 bp, Artificial Sequence
  Synthesized adaptor oligonucleotide
  misc_feature (34)..(36): n is a, c, g, or t
tgcaggaccagagaattcgaatacagtgctcccnnntgcatcaggt

SEQ ID NO: 1204 - DNA, 46 bp, Artificial Sequence
  Synthesized adaptor oligonucleotide
  misc_feature (34)..(36): n is a, c, g, or t
tgcaggaccagagaattcgaatacagccaccagnnntgcatcaggt

SEQ ID NO: 1205 - DNA, 46 bp, Artificial Sequence
  Synthesized adaptor oligonucleotide
  misc_feature (34)..(36): n is a, c, g, or t
tgcaggaccagagaattcgaatacattatgtgannntgcatcaggt

SEQ ID NO: 1206 - DNA, 46 bp, Artificial Sequence
  Synthesized adaptor oligonucleotide
  misc_feature (34)..(36): n is a, c, g, or t
tgcaggaccagagaattcgaatacaatactcccnnntgcatcaggt

SEQ ID NO: 1207 - DNA, 46 bp, Artificial Sequence
  Synthesized adaptor oligonucleotide
  misc_feature (34)..(36): n is a, c, g, or t
tgcaggaccagagaattcgaatacaactatggcnnntgcatcaggt

SEQ ID NO: 1208 - DNA, 46 bp, Artificial Sequence
  Synthesized adaptor oligonucleotide
  misc_feature (34)..(36): n is a, c, g, or t
tgcaggaccagagaattcgaatacaacggcctgnnntgcatcaggt

SEQ ID NO: 1209 - DNA, 46 bp, Artificial Sequence
  Synthesized adaptor oligonucleotide
  misc_feature (34)..(36): n is a, c, g, or t
tgcaggaccagagaattcgaatacacaatgaccnnnacgtatgcca

SEQ ID NO: 1210 - DNA, 46 bp, Artificial Sequence
  Synthesized adaptor oligonucleotide
  misc_feature (34)..(36): n is a, c, g, or t
tgcaggaccagagaattcgaatacagctacgtannnacgtatgcca

SEQ ID NO: 1211 - DNA, 46 bp, Artificial Sequence
  Synthesized adaptor oligonucleotide
  misc_feature (34)..(36): n is a, c, g, or t
tgcaggaccagagaattcgaatacagccagcacnnnacgtatgcca

SEQ ID NO: 1212 - DNA, 46 bp, Artificial Sequence
  Synthesized adaptor oligonucleotide
  misc_feature (34)..(36): n is a, c, g, or t
tgcaggaccagagaattcgaatacacgatccggnnnacgtatgcca

SEQ ID NO: 1213 - DNA, 46 bp, Artificial Sequence
  Synthesized adaptor oligonucleotide
  misc_feature (34)..(36): n is a, c, g, or t
tgcaggaccagagaattcgaatacattggacacnnnacgtatgcca

SEQ ID NO: 1214 - DNA, 46 bp, Artificial Sequence
  Synthesized adaptor oligonucleotide
  misc_feature (34)..(36): n is a, c, g, or t
tgcaggaccagagaattcgaatacaacaatgccnnnacgtatgcca

SEQ ID NO: 1215 - DNA, 46 bp, Artificial Sequence
  Synthesized adaptor oligonucleotide
  misc_feature (34)..(36): n is a, c, g, or t
tgcaggaccagagaattcgaatacacctttatannnacgtatgcca

SEQ ID NO: 1216 - DNA, 46 bp, Artificial Sequence
  Synthesized adaptor oligonucleotide
  misc_feature (34)..(36): n is a, c, g, or t
tgcaggaccagagaattcgaatacagtggctgcnnnacgtatgcca

SEQ ID NO: 1217 - DNA, 46 bp, Artificial Sequence
  Synthesized adaptor oligonucleotide
  misc_feature (34)..(36): n is a, c, g, or t
tgcaggaccagagaattcgaatacaatctccgtnnnacgtatgcca

SEQ ID NO: 1218 - DNA, 46 bp, Artificial Sequence
  Synthesized adaptor oligonucleotide
  misc_feature (34)..(36): n is a, c, g, or t
tgcaggaccagagaattcgaatacaatggccatnnnacgtatgcca

SEQ ID NO: 1219 - DNA, 46 bp, Artificial Sequence
  Synthesized adaptor oligonucleotide
  misc_feature (34)..(36): n is a, c, g, or t
tgcaggaccagagaattcgaatacatttgatagnnnacgtatgcca

SEQ ID NO: 1220 - DNA, 46 bp, Artificial Sequence
  Synthesized adaptor oligonucleotide
  misc_feature (34)..(36): n is a, c, g, or t
tgcaggaccagagaattcgaatacagtcccggannnacgtatgcca

SEQ ID NO: 1221 - DNA, 46 bp, Artificial Sequence
  Synthesized adaptor oligonucleotide
  misc_feature (34)..(36): n is a, c, g, or t
tgcaggaccagagaattcgaatacaggcttcaannnacgtatgcca

SEQ ID NO: 1222 - DNA, 46 bp, Artificial Sequence
  Synthesized adaptor oligonucleotide
  misc_feature (34)..(36): n is a, c, g, or t
tgcaggaccagagaattcgaatacaccttttttnnnacgtatgcca

SEQ ID NO: 1223 - DNA, 46 bp, Artificial Sequence
  Synthesized adaptor oligonucleotide
  misc_feature (34)..(36): n is a, c, g, or t
tgcaggaccagagaattcgaatacaacgcccgannnacgtatgcca

SEQ ID NO: 1224 - DNA, 46 bp, Artificial Sequence
  Synthesized adaptor oligonucleotide
  misc_feature (34)..(36): n is a, c, g, or t
tgcaggaccagagaattcgaatacacccctagcnnnacgtatgcca

SEQ ID NO: 1225 - DNA, 46 bp, Artificial Sequence
  Synthesized adaptor oligonucleotide
  misc_feature (34)..(36): n is a, c, g, or t
tgcaggaccagagaattcgaatacacggaggcannnacgtatgcca

SEQ ID NO: 1226 - DNA, 46 bp, Artificial Sequence
  Synthesized adaptor oligonucleotide
  misc_feature (34)..(36): n is a, c, g, or t
tgcaggaccagagaattcgaatacactatgaatnnnacgtatgcca

SEQ ID NO: 1227 - DNA, 46 bp, Artificial Sequence
  Synthesized adaptor oligonucleotide
  misc_feature (34)..(36): n is a, c, g, or t
tgcaggaccagagaattcgaatacagaccgcgtnnnacgtatgcca

SEQ ID NO: 1228 - DNA, 46 bp, Artificial Sequence
  Synthesized adaptor oligonucleotide
  misc_feature (34)..(36): n is a, c, g, or t
tgcaggaccagagaattcgaatacatactagtannnacgtatgcca

SEQ ID NO: 1229 - DNA, 46 bp, Artificial Sequence
  Synthesized adaptor oligonucleotide
  misc_feature (34)..(36): n is a, c, g, or t
tgcaggaccagagaattcgaatacaaccagtgtnnnacgtatgcca

SEQ ID NO: 1230 - DNA, 46 bp, Artificial Sequence
  Synthesized adaptor oligonucleotide
  misc_feature (34)..(36): n is a, c, g, or t
tgcaggaccagagaattcgaatacagatgcctannnacgtatgcca

SEQ ID NO: 1231 - DNA, 46 bp, Artificial Sequence
  Synthesized adaptor oligonucleotide
  misc_feature (34)..(36): n is a, c, g, or t
tgcaggaccagagaattcgaatacaccatatttnnnacgtatgcca

SEQ ID NO: 1232 - DNA, 46 bp, Artificial Sequence
  Synthesized adaptor oligonucleotide
  misc_feature (34)..(36): n is a, c, g, or t
tgcaggaccagagaattcgaatacaaaaccaccnnnacgtatgcca

SEQ ID NO: 1233 - DNA, 46 bp, Artificial Sequence
  Synthesized adaptor oligonucleotide
  misc_feature (34)..(36): n is a, c, g, or t
tgcaggaccagagaattcgaatacagcacgaaannnacgtatgcca

SEQ ID NO: 1234 - DNA, 46 bp, Artificial Sequence
  Synthesized adaptor oligonucleotide
  misc_feature (34)..(36): n is a, c, g, or t
tgcaggaccagagaattcgaatacaacgacagannnacgtatgcca

SEQ ID NO: 1235 - DNA, 46 bp, Artificial Sequence
  Synthesized adaptor oligonucleotide
  misc_feature (34)..(36): n is a, c, g, or t
tgcaggaccagagaattcgaatacaataccatannnacgtatgcca

SEQ ID NO: 1236 - DNA, 46 bp, Artificial Sequence
  Synthesized adaptor oligonucleotide
  misc_feature (34)..(36): n is a, c, g, or t
tgcaggaccagagaattcgaatacaccagttctnnnacgtatgcca

SEQ ID NO: 1237 - DNA, 46 bp, Artificial Sequence
  Synthesized adaptor oligonucleotide
  misc_feature (34)..(36): n is a, c, g, or t
tgcaggaccagagaattcgaatacattgctggannnacgtatgcca

SEQ ID NO: 1238 - DNA, 46 bp, Artificial Sequence
  Synthesized adaptor oligonucleotide
  misc_feature (34)..(36): n is a, c, g, or t
tgcaggaccagagaattcgaatacagcccatttnnnacgtatgcca

SEQ ID NO: 1239 - DNA, 46 bp, Artificial Sequence
  Synthesized adaptor oligonucleotide
  misc_feature (34)..(36): n is a, c, g, or t
tgcaggaccagagaattcgaatacaaacagctcnnnacgtatgcca

SEQ ID NO: 1240 - DNA, 46 bp, Artificial Sequence
  Synthesized adaptor oligonucleotide
  misc_feature (34)..(36): n is a, c, g, or t
tgcaggaccagagaattcgaatacactgttctgnnnacgtatgcca

SEQ ID NO: 1241 - DNA, 46 bp, Artificial Sequence
  Synthesized adaptor oligonucleotide
  misc_feature (34)..(36): n is a, c, g, or t
tgcaggaccagagaattcgaatacatggaataannnacgtatgcca

SEQ ID NO: 1242 - DNA, 46 bp, Artificial Sequence
  Synthesized adaptor oligonucleotide
  misc_feature (34)..(36): n is a, c, g, or t
tgcaggaccagagaattcgaatacattcccttcnnnacgtatgcca

SEQ ID NO: 1243 - DNA, 46 bp, Artificial Sequence
  Synthesized adaptor oligonucleotide
  misc_feature (34)..(36): n is a, c, g, or t
tgcaggaccagagaattcgaatacacacgcaatnnnacgtatgcca

SEQ ID NO: 1244 - DNA, 46 bp, Artificial Sequence
  Synthesized adaptor oligonucleotide
  misc_feature (34)..(36): n is a, c, g, or t
tgcaggaccagagaattcgaatacagcttatccnnnacgtatgcca

SEQ ID NO: 1245 - DNA, 46 bp, Artificial Sequence
  Synthesized adaptor oligonucleotide
  misc_feature (34)..(36): n is a, c, g, or t
tgcaggaccagagaattcgaatacaggcatagannnacgtatgcca

SEQ ID NO: 1246 - DNA, 46 bp, Artificial Sequence
  Synthesized adaptor oligonucleotide
  misc_feature (34)..(36): n is a, c, g, or t
tgcaggaccagagaattcgaatacaagcgccgtnnnacgtatgcca

SEQ ID NO: 1247 - DNA, 46 bp, Artificial Sequence
  Synthesized adaptor oligonucleotide
  misc_feature (34)..(36): n is a, c, g, or t
tgcaggaccagagaattcgaatacacaaattcannnacgtatgcca

SEQ ID NO: 1248 - DNA, 46 bp, Artificial Sequence
  Synthesized adaptor oligonucleotide
  misc_feature (34)..(36): n is a, c, g, or t
tgcaggaccagagaattcgaatacataatgcatnnnacgtatgcca

SEQ ID NO: 1249 - DNA, 46 bp, Artificial Sequence
  Synthesized adaptor oligonucleotide
  misc_feature (34)..(36): n is a, c, g, or t
tgcaggaccagagaattcgaatacaactcgtctnnnacgtatgcca

SEQ ID NO: 1250 - DNA, 46 bp, Artificial Sequence
  Synthesized adaptor oligonucleotide
  misc_feature (34)..(36): n is a, c, g, or t
tgcaggaccagagaattcgaatacaaatttgtgnnnacgtatgcca

SEQ ID NO: 1251 - DNA, 46 bp, Artificial Sequence
  Synthesized adaptor oligonucleotide
  misc_feature (34)..(36): n is a, c, g, or t
tgcaggaccagagaattcgaatacatgagaggtnnnacgtatgcca

SEQ ID NO: 1252 - DNA, 46 bp, Artificial Sequence
  Synthesized adaptor oligonucleotide
  misc_feature (34)..(36): n is a, c, g, or t
tgcaggaccagagaattcgaatacagccatacannnacgtatgcca

SEQ ID NO: 1253 - DNA, 46 bp, Artificial Sequence
  Synthesized adaptor oligonucleotide
  misc_feature (34)..(36): n is a, c, g, or t
tgcaggaccagagaattcgaatacagtccttcannnacgtatgcca

SEQ ID NO: 1254 - DNA, 46 bp, Artificial Sequence
  Synthesized adaptor oligonucleotide
  misc_feature (34)..(36): n is a, c, g, or t
tgcaggaccagagaattcgaatacagtgcggagnnnacgtatgcca

SEQ ID NO: 1255 - DNA, 46 bp, Artificial Sequence
  Synthesized adaptor oligonucleotide
  misc_feature (34)..(36): n is a, c, g, or t
tgcaggaccagagaattcgaatacatttagacannnacgtatgcca

SEQ ID NO: 1256 - DNA, 46 bp, Artificial Sequence
  Synthesized adaptor oligonucleotide
  misc_feature (34)..(36): n is a, c, g, or t
tgcaggaccagagaattcgaatacacacccgctnnnacgtatgcca

SEQ ID NO: 1257 - DNA, 46 bp, Artificial Sequence
  Synthesized adaptor oligonucleotide
  misc_feature (34)..(36): n is a, c, g, or t
tgcaggaccagagaattcgaatacaattctagannnacgtatgcca

SEQ ID NO: 1258 - DNA, 46 bp, Artificial Sequence
  Synthesized adaptor oligonucleotide
  misc_feature (34)..(36): n is a, c, g, or t
tgcaggaccagagaattcgaatacacggacgagnnnacgtatgcca

SEQ ID NO: 1259 - DNA, 46 bp, Artificial Sequence
  Synthesized adaptor oligonucleotide
  misc_feature (34)..(36): n is a, c, g, or t
tgcaggaccagagaattcgaatacacgaccgcannnacgtatgcca

SEQ ID NO: 1260 - DNA, 46 bp, Artificial Sequence
  Synthesized adaptor oligonucleotide
  misc_feature (34)..(36): n is a, c, g, or t
tgcaggaccagagaattcgaatacacatatagtnnnacgtatgcca

SEQ ID NO: 1261 - DNA, 46 bp, Artificial Sequence
  Synthesized adaptor oligonucleotide
  misc_feature (34)..(36): n is a, c, g, or t
tgcaggaccagagaattcgaatacatgtgatatnnnacgtatgcca

SEQ ID NO: 1262 - DNA, 46 bp, Artificial Sequence
  Synthesized adaptor oligonucleotide
  misc_feature (34)..(36): n is a, c, g, or t
tgcaggaccagagaattcgaatacaatcctaaannnacgtatgcca

SEQ ID NO: 1263 - DNA, 46 bp, Artificial Sequence
  Synthesized adaptor oligonucleotide
  misc_feature (34)..(36): n is a, c, g, or t
tgcaggaccagagaattcgaatacatgatgaggnnnacgtatgcca

SEQ ID NO: 1264 - DNA, 46 bp, Artificial Sequence
  Synthesized adaptor oligonucleotide
  misc_feature (34)..(36): n is a, c, g, or t
tgcaggaccagagaattcgaatacagctcgacgnnnacgtatgcca

SEQ ID NO: 1265 - DNA, 46 bp, Artificial Sequence
  Synthesized adaptor oligonucleotide
  misc_feature (34)..(36): n is a, c, g, or t
tgcaggaccagagaattcgaatacattagctaannnacgtatgcca

SEQ ID NO: 1266 - DNA, 46 bp, Artificial Sequence
  Synthesized adaptor oligonucleotide
  misc_feature (34)..(36): n is a, c, g, or t
tgcaggaccagagaattcgaatacatgcttttannnacgtatgcca

SEQ ID NO: 1267 - DNA, 46 bp, Artificial Sequence
  Synthesized adaptor oligonucleotide
  misc_feature (34)..(36): n is a, c, g, or t
tgcaggaccagagaattcgaatacaatcacagcnnnacgtatgcca

SEQ ID NO: 1268 - DNA, 46 bp, Artificial Sequence
  Synthesized adaptor oligonucleotide
  misc_feature (34)..(36): n is a, c, g, or t
tgcaggaccagagaattcgaatacaaatctcggnnnacgtatgcca

SEQ ID NO: 1269 - DNA, 46 bp, Artificial Sequence
  Synthesized adaptor oligonucleotide
  misc_feature (34)..(36): n is a, c, g, or t
tgcaggaccagagaattcgaatacaacactggtnnnctagcgttac

SEQ ID NO: 1270 - DNA, 46 bp, Artificial Sequence
  Synthesized adaptor oligonucleotide
  misc_feature (34)..(36): n is a, c, g, or t
tgcaggaccagagaattcgaatacatttgtttgnnnctagcgttac

SEQ ID NO: 1271 - DNA, 46 bp, Artificial Sequence
  Synthesized adaptor oligonucleotide
  misc_feature (34)..(36): n is a, c, g, or t
tgcaggaccagagaattcgaatacacgacacgcnnnctagcgttac

SEQ ID NO: 1272 - DNA, 46 bp, Artificial Sequence
  Synthesized adaptor oligonucleotide
  misc_feature (34)..(36): n is a, c, g, or t
tgcaggaccagagaattcgaatacacgcgagagnnnctagcgttac

SEQ ID NO: 1273 - DNA, 46 bp, Artificial Sequence
  Synthesized adaptor oligonucleotide
  misc_feature (34)..(36): n is a, c, g, or t
tgcaggaccagagaattcgaatacataagtagannnctagcgttac

SEQ ID NO: 1274 - DNA, 46 bp, Artificial Sequence
  Synthesized adaptor oligonucleotide
  misc_feature (34)..(36): n is a, c, g, or t
tgcaggaccagagaattcgaatacaaagacgtgnnnctagcgttac

SEQ ID NO: 1275 - DNA, 46 bp, Artificial Sequence
  Synthesized adaptor oligonucleotide
  misc_feature (34)..(36): n is a, c, g, or t
tgcaggaccagagaattcgaatacacggaacaannnctagcgttac

SEQ ID NO: 1276 - DNA, 46 bp, Artificial Sequence
  Synthesized adaptor oligonucleotide
  misc_feature (34)..(36): n is a, c, g, or t
tgcaggaccagagaattcgaatacactgtcgaannnctagcgttac

SEQ ID NO: 1277 - DNA, 46 bp, Artificial Sequence
  Synthesized adaptor oligonucleotide
  misc_feature (34)..(36): n is a, c, g, or t
tgcaggaccagagaattcgaatacaagcctacannnctagcgttac

SEQ ID NO: 1278 - DNA, 46 bp, Artificial Sequence
  Synthesized adaptor oligonucleotide
  misc_feature (34)..(36): n is a, c, g, or t
tgcaggaccagagaattcgaatacaccaattggnnnctagcgttac

SEQ ID NO: 1279 - DNA, 46 bp, Artificial Sequence
  Synthesized adaptor oligonucleotide
  misc_feature (34)..(36): n is a, c, g, or t
tgcaggaccagagaattcgaatacagagtctacnnnctagcgttac

SEQ ID NO: 1280 - DNA, 46 bp, Artificial Sequence
  Synthesized adaptor oligonucleotide
  misc_feature (34)..(36): n is a, c, g, or t
tgcaggaccagagaattcgaatacaaatgttacnnnctagcgttac

SEQ ID NO: 1281 - DNA, 46 bp, Artificial Sequence
  Synthesized adaptor oligonucleotide
  misc_feature (34)..(36): n is a, c, g, or t
tgcaggaccagagaattcgaatacaagtggcaannnctagcgttac

SEQ ID NO: 1282 - DNA, 46 bp, Artificial Sequence
  Synthesized adaptor oligonucleotide
  misc_feature (34)..(36): n is a, c, g, or t
tgcaggaccagagaattcgaatacaggttaaccnnnctagcgttac

SEQ ID NO: 1283 - DNA, 46 bp, Artificial Sequence
  Synthesized adaptor oligonucleotide
  misc_feature (34)..(36): n is a, c, g, or t
tgcaggaccagagaattcgaatacattgtggtgnnnctagcgttac

SEQ ID NO: 1284 - DNA, 46 bp, Artificial Sequence
  Synthesized adaptor oligonucleotide
  misc_feature (34)..(36): n is a, c, g, or t
tgcaggaccagagaattcgaatacaaaatggcgnnnctagcgttac

SEQ ID NO: 1285 - DNA, 46 bp, Artificial Sequence
  Synthesized adaptor oligonucleotide
  misc_feature (34)..(36): n is a, c, g, or t
tgcaggaccagagaattcgaatacactgtaggtnnnctagcgttac

SEQ ID NO: 1286 - DNA, 46 bp, Artificial Sequence
  Synthesized adaptor oligonucleotide
  misc_feature (34)..(36): n is a, c, g, or t
tgcaggaccagagaattcgaatacactaagcgtnnnctagcgttac

SEQ ID NO: 1287 - DNA, 46 bp, Artificial Sequence
  Synthesized adaptor oligonucleotide
  misc_feature (34)..(36): n is a, c, g, or t
tgcaggaccagagaattcgaatacagtttatgannnctagcgttac

SEQ ID NO: 1288 - DNA, 46 bp, Artificial Sequence
  Synthesized adaptor oligonucleotide
  misc_feature (34)..(36): n is a, c, g, or t
tgcaggaccagagaattcgaatacaacgactgtnnnctagcgttac

SEQ ID NO: 1289 - DNA, 46 bp, Artificial Sequence
  Synthesized adaptor oligonucleotide
  misc_feature (34)..(36): n is a, c, g, or t
tgcaggaccagagaattcgaatacacctagtagnnnctagcgttac

SEQ ID NO: 1290 - DNA, 46 bp, Artificial Sequence
  Synthesized adaptor oligonucleotide
  misc_feature (34)..(36): n is a, c, g, or t
tgcaggaccagagaattcgaatacaggttctgannnctagcgttac

SEQ ID NO: 1291 - DNA, 46 bp, Artificial Sequence
  Synthesized adaptor oligonucleotide
  misc_feature (34)..(36): n is a, c, g, or t
tgcaggaccagagaattcgaatacatacatcccnnnctagcgttac

SEQ ID NO: 1292 - DNA, 46 bp, Artificial Sequence
  Synthesized adaptor oligonucleotide
  misc_feature (34)..(36): n is a, c, g, or t
tgcaggaccagagaattcgaatacactcggaatnnnctagcgttac

SEQ ID NO: 1293 - DNA, 46 bp, Artificial Sequence
  Synthesized adaptor oligonucleotide
  misc_feature (34)..(36): n is a, c, g, or t
tgcaggaccagagaattcgaatacatcagttggnnnctagcgttac

SEQ ID NO: 1294 - DNA, 46 bp, Artificial Sequence
  Synthesized adaptor oligonucleotide
  misc_feature (34)..(36): n is a, c, g, or t
tgcaggaccagagaattcgaatacaagtgcctannnctagcgttac

SEQ ID NO: 1295 - DNA, 46 bp, Artificial Sequence
  Synthesized adaptor oligonucleotide
  misc_feature (34)..(36): n is a, c, g, or t
tgcaggaccagagaattcgaatacagtatgtatnnnctagcgttac

SEQ ID NO: 1296 - DNA, 46 bp, Artificial Sequence
  Synthesized adaptor oligonucleotide
  misc_feature (34)..(36): n is a, c, g, or t
tgcaggaccagagaattcgaatacagcagcaggnnnctagcgttac

SEQ ID NO: 1297 - DNA, 46 bp, Artificial Sequence
  Synthesized adaptor oligonucleotide
  misc_feature (34)..(36): n is a, c, g, or t
tgcaggaccagagaattcgaatacagcaggtccnnnctagcgttac

SEQ ID NO: 1298 - DNA, 46 bp, Artificial Sequence
  Synthesized adaptor oligonucleotide
  misc_feature (34)..(36): n is a, c, g, or t
tgcaggaccagagaattcgaatacatgtaggctnnnctagcgttac

SEQ ID NO: 1299 - DNA, 46 bp, Artificial Sequence
  Synthesized adaptor oligonucleotide
  misc_feature (34)..(36): n is a, c, g, or t
tgcaggaccagagaattcgaatacataacgaccnnnctagcgttac

SEQ ID NO: 1300 - DNA, 46 bp, Artificial Sequence
  Synthesized adaptor oligonucleotide
  misc_feature (34)..(36): n is a, c, g, or t
tgcaggaccagagaattcgaatacacgatcggcnnnctagcgttac

SEQ ID NO: 1301 - DNA, 46 bp, Artificial Sequence
  Synthesized adaptor oligonucleotide
  misc_feature (34)..(36): n is a, c, g, or t
tgcaggaccagagaattcgaatacaggccaaggnnnctagcgttac

SEQ ID NO: 1302 - DNA, 46 bp, Artificial Sequence
  Synthesized adaptor oligonucleotide
  misc_feature (34)..(36): n is a, c, g, or t
tgcaggaccagagaattcgaatacagacataaannnctagcgttac

SEQ ID NO: 1303 - DNA, 46 bp, Artificial Sequence
  Synthesized adaptor oligonucleotide
  misc_feature (34)..(36): n is a, c, g, or t
tgcaggaccagagaattcgaatacacgcacatannnctagcgttac

SEQ ID NO: 1304 - DNA, 46 bp, Artificial Sequence
  Synthesized adaptor oligonucleotide
  misc_feature (34)..(36): n is a, c, g, or t
tgcaggaccagagaattcgaatacagcctaggcnnnctagcgttac

SEQ ID NO: 1305 - DNA, 46 bp, Artificial Sequence
  Synthesized adaptor oligonucleotide
  misc_feature (34)..(36): n is a, c, g, or t
tgcaggaccagagaattcgaatacatccgcaaannnctagcgttac

SEQ ID NO: 1306 - DNA, 46 bp, Artificial Sequence
  Synthesized adaptor oligonucleotide
  misc_feature (34)..(36): n is a, c, g, or t
tgcaggaccagagaattcgaatacacttatagannnctagcgttac

SEQ ID NO: 1307 - DNA, 46 bp, Artificial Sequence
  Synthesized adaptor oligonucleotide
  misc_feature (34)..(36): n is a, c, g, or t
tgcaggaccagagaattcgaatacacggcggaannnctagcgttac

SEQ ID NO: 1308 - DNA, 46 bp, Artificial Sequence
  Synthesized adaptor oligonucleotide
  misc_feature (34)..(36): n is a, c, g, or t
tgcaggaccagagaattcgaatacagtagcactnnnctagcgttac

SEQ ID NO: 1309 - DNA, 46 bp, Artificial Sequence
  Synthesized adaptor oligonucleotide
  misc_feature (34)..(36): n is a, c, g, or t
tgcaggaccagagaattcgaatacagctgtcaannnctagcgttac

SEQ ID NO: 1310 - DNA, 46 bp, Artificial Sequence
  Synthesized adaptor oligonucleotide
  misc_feature (34)..(36): n is a, c, g, or t
tgcaggaccagagaattcgaatacagtgccagcnnnctagcgttac

SEQ ID NO: 1311 - DNA, 46 bp, Artificial Sequence
  Synthesized adaptor oligonucleotide
  misc_feature (34)..(36): n is a, c, g, or t
tgcaggaccagagaattcgaatacattcatatcnnnctagcgttac

SEQ ID NO: 1312 - DNA, 46 bp, Artificial Sequence
  Synthesized adaptor oligonucleotide
  misc_feature (34)..(36): n is a, c, g, or t
tgcaggaccagagaattcgaatacacccatgccnnnctagcgttac

SEQ ID NO: 1313 - DNA, 46 bp, Artificial Sequence
  Synthesized adaptor oligonucleotide
  misc_feature (34)..(36): n is a, c, g, or t
tgcaggaccagagaattcgaatacattagttgannnctagcgttac

SEQ ID NO: 1314 - DNA, 46 bp, Artificial Sequence
  Synthesized adaptor oligonucleotide
  misc_feature (34)..(36): n is a, c, g, or t
tgcaggaccagagaattcgaatacaatcagaaannnctagcgttac

SEQ ID NO: 1315 - DNA, 46 bp, Artificial Sequence
  Synthesized adaptor oligonucleotide
  misc_feature (34)..(36): n is a, c, g, or t
tgcaggaccagagaattcgaatacattagaactnnnctagcgttac

SEQ ID NO: 1316 - DNA, 46 bp, Artificial Sequence
  Synthesized adaptor oligonucleotide
  misc_feature (34)..(36): n is a, c, g, or t
tgcaggaccagagaattcgaatacagtgctatgnnnctagcgttac

SEQ ID NO: 1317 - DNA, 46 bp, Artificial Sequence
  Synthesized adaptor oligonucleotide
  misc_feature (34)..(36): n is a, c, g, or t
tgcaggaccagagaattcgaatacattggatcgnnnctagcgttac

SEQ ID NO: 1318 - DNA, 46 bp, Artificial Sequence
  Synthesized adaptor oligonucleotide
  misc_feature (34)..(36): n is a, c, g, or t
tgcaggaccagagaattcgaatacacaagaatannnctagcgttac

SEQ ID NO: 1319 - DNA, 46 bp, Artificial Sequence
  Synthesized adaptor oligonucleotide
  misc_feature (34)..(36): n is a, c, g, or t
tgcaggaccagagaattcgaatacaagcaccatnnnctagcgttac

SEQ ID NO: 1320 - DNA, 46 bp, Artificial Sequence
  Synthesized adaptor oligonucleotide
  misc_feature (34)..(36): n is a, c, g, or t
tgcaggaccagagaattcgaatacaactagaccnnnctagcgttac

SEQ ID NO: 1321 - DNA, 46 bp, Artificial Sequence
  Synthesized adaptor oligonucleotide
  misc_feature (34)..(36): n is a, c, g, or t
tgcaggaccagagaattcgaatacaatcattagnnnctagcgttac

SEQ ID NO: 1322 - DNA, 46 bp, Artificial Sequence
  Synthesized adaptor oligonucleotide
  misc_feature (34)..(36): n is a, c, g, or t
tgcaggaccagagaattcgaatacaagaacctcnnnctagcgttac

SEQ ID NO: 1323 - DNA, 46 bp, Artificial Sequence
  Synthesized adaptor oligonucleotide
  misc_feature (34)..(36): n is a, c, g, or t
tgcaggaccagagaattcgaatacagattttctnnnctagcgttac

SEQ ID NO: 1324 - DNA, 46 bp, Artificial Sequence
  Synthesized adaptor oligonucleotide
  misc_feature (34)..(36): n is a, c, g, or t
tgcaggaccagagaattcgaatacaagtacggannnctagcgttac

SEQ ID NO: 1325 - DNA, 46 bp, Artificial Sequence
  Synthesized adaptor oligonucleotide
  misc_feature (34)..(36): n is a, c, g, or t
tgcaggaccagagaattcgaatacacgcctaaannnctagcgttac

SEQ ID NO: 1326 - DNA, 46 bp, Artificial Sequence
  Synthesized adaptor oligonucleotide
  misc_feature (34)..(36): n is a, c, g, or t
tgcaggaccagagaattcgaatacaagttggtcnnnctagcgttac

SEQ ID NO: 1327 - DNA, 46 bp, Artificial Sequence
  Synthesized adaptor oligonucleotide
  misc_feature (34)..(36): n is a, c, g, or t
tgcaggaccagagaattcgaatacatgcgcacgnnnctagcgttac

SEQ ID NO: 1328 - DNA, 46 bp, Artificial Sequence
  Synthesized adaptor oligonucleotide
  misc_feature (34)..(36): n is a, c, g, or t
tgcaggaccagagaattcgaatacattggtacgnnnctagcgttac

SEQ ID NO: 1329 - DNA, 46 bp, Artificial Sequence
  Synthesized adaptor oligonucleotide
  misc_feature (34)..(36): n is a, c, g, or t
tgcaggaccagagaattcgaatacaatgagatannngatcgacatg

SEQ ID NO: 1330 - DNA, 46 bp, Artificial Sequence
  Synthesized adaptor oligonucleotide
  misc_feature (34)..(36): n is a, c, g, or t
tgcaggaccagagaattcgaatacaatcggtacnnngatcgacatg

SEQ ID NO: 1331 - DNA, 46 bp, Artificial Sequence
  Synthesized adaptor oligonucleotide
  misc_feature (34)..(36): n is a, c, g, or t
tgcaggaccagagaattcgaatacatgtcgttcnnngatcgacatg

SEQ ID NO: 1332 - DNA, 46 bp, Artificial Sequence
  Synthesized adaptor oligonucleotide
  misc_feature (34)..(36): n is a, c, g, or t
tgcaggaccagagaattcgaatacatgtgtatannngatcgacatg

SEQ ID NO: 1333 - DNA, 46 bp, Artificial Sequence
  Synthesized adaptor oligonucleotide
  misc_feature (34)..(36): n is a, c, g, or t
tgcaggaccagagaattcgaatacagtggatctnnngatcgacatg

SEQ ID NO: 1334 - DNA, 46 bp, Artificial Sequence
  Synthesized adaptor oligonucleotide
  misc_feature (34)..(36): n is a, c, g, or t
tgcaggaccagagaattcgaatacatcttcaatnnngatcgacatg

SEQ ID NO: 1335 - DNA, 46 bp, Artificial Sequence
  Synthesized adaptor oligonucleotide
  misc_feature (34)..(36): n is a, c, g, or t
tgcaggaccagagaattcgaatacacgcgtgtgnnngatcgacatg

SEQ ID NO: 1336 - DNA, 46 bp, Artificial Sequence
  Synthesized adaptor oligonucleotide
  misc_feature (34)..(36): n is a, c, g, or t
tgcaggaccagagaattcgaatacactcctcggnnngatcgacatg

SEQ ID NO: 1337 - DNA, 46 bp, Artificial Sequence
  Synthesized adaptor oligonucleotide
  misc_feature (34)..(36): n is a, c, g, or t
tgcaggaccagagaattcgaatacagactaattnnngatcgacatg

SEQ ID NO: 1338 - DNA, 46 bp, Artificial Sequence
  Synthesized adaptor oligonucleotide
  misc_feature (34)..(36): n is a, c, g, or t
tgcaggaccagagaattcgaatacacaataagannngatcgacatg

SEQ ID NO: 1339 - DNA, 46 bp, Artificial Sequence
  Synthesized adaptor oligonucleotide
  misc_feature (34)..(36): n is a, c, g, or t
tgcaggaccagagaattcgaatacatttaccgcnnngatcgacatg

SEQ ID NO: 1340 - DNA, 46 bp, Artificial Sequence
  Synthesized adaptor oligonucleotide
  misc_feature (34)..(36): n is a, c, g, or t
tgcaggaccagagaattcgaatacagtgtattannngatcgacatg

SEQ ID NO: 1341 - DNA, 46 bp, Artificial Sequence
  Synthesized adaptor oligonucleotide
  misc_feature (34)..(36): n is a, c, g, or t
tgcaggaccagagaattcgaatacaagatgtaannngatcgacatg

SEQ ID NO: 1342 - DNA, 46 bp, Artificial Sequence
  Synthesized adaptor oligonucleotide
  misc_feature (34)..(36): n is a, c, g, or t
tgcaggaccagagaattcgaatacattattcgtnnngatcgacatg

SEQ ID NO: 1343 - DNA, 46 bp, Artificial Sequence
  Synthesized adaptor oligonucleotide
  misc_feature (34)..(36): n is a, c, g, or t
tgcaggaccagagaattcgaatacaagtcacacnnngatcgacatg

SEQ ID NO: 1344 - DNA, 46 bp, Artificial Sequence
  Synthesized adaptor oligonucleotide
  misc_feature (34)..(36): n is a, c, g, or t
tgcaggaccagagaattcgaatacactgacaacnnngatcgacatg

SEQ ID NO: 1345 - DNA, 46 bp, Artificial Sequence
  Synthesized adaptor oligonucleotide
  misc_feature (34)..(36): n is a, c, g, or t
tgcaggaccagagaattcgaatacaacgccggtnnngatcgacatg

SEQ ID NO: 1346 - DNA, 46 bp, Artificial Sequence
  Synthesized adaptor oligonucleotide
  misc_feature (34)..(36): n is a, c, g, or t
tgcaggaccagagaattcgaatacaggtgacccnnngatcgacatg

SEQ ID NO: 1347 - DNA, 46 bp, Artificial Sequence
  Synthesized adaptor oligonucleotide
  misc_feature (34)..(36): n is a, c, g, or t
tgcaggaccagagaattcgaatacaccttagctnnngatcgacatg

SEQ ID NO: 1348 - DNA, 46 bp, Artificial Sequence
  Synthesized adaptor oligonucleotide
  misc_feature (34)..(36): n is a, c, g, or t
tgcaggaccagagaattcgaatacactcgctatnnngatcgacatg

SEQ ID NO: 1349 - DNA, 46 bp, Artificial Sequence
  Synthesized adaptor oligonucleotide
  misc_feature (34)..(36): n is a, c, g, or t
tgcaggaccagagaattcgaatacaagcctagtnnngatcgacatg

SEQ ID NO: 1350 - DNA, 46 bp, Artificial Sequence
  Synthesized adaptor oligonucleotide
  misc_feature (34)..(36): n is a, c, g, or t
tgcaggaccagagaattcgaatacagagagttgnnngatcgacatg

SEQ ID NO: 1351 - DNA, 46 bp, Artificial Sequence
  Synthesized adaptor oligonucleotide
  misc_feature (34)..(36): n is a, c, g, or t
tgcaggaccagagaattcgaatacataagaggcnnngatcgacatg

SEQ ID NO: 1352 - DNA, 46 bp, Artificial Sequence
  Synthesized adaptor oligonucleotide
  misc_feature (34)..(36): n is a, c, g, or t
tgcaggaccagagaattcgaatacagttaatacnnngatcgacatg

SEQ ID NO: 1353 - DNA, 46 bp, Artificial Sequence
  Synthesized adaptor oligonucleotide
  misc_feature (34)..(36): n is a, c, g, or t
tgcaggaccagagaattcgaatacaggtccgcannngatcgacatg

SEQ ID NO: 1354 - DNA, 46 bp, Artificial Sequence
  Synthesized adaptor oligonucleotide
  misc_feature (34)..(36): n is a, c, g, or t
tgcaggaccagagaattcgaatacataagcattnnngatcgacatg

SEQ ID NO: 1355 - DNA, 46 bp, Artificial Sequence
  Synthesized adaptor oligonucleotide
  misc_feature (34)..(36): n is a, c, g, or t
tgcaggaccagagaattcgaatacagtacgcatnnngatcgacatg

SEQ ID NO: 1356 - DNA, 46 bp, Artificial Sequence
  Synthesized adaptor oligonucleotide
  misc_feature (34)..(36): n is a, c, g, or t
tgcaggaccagagaattcgaatacaaacgaacgnnngatcgacatg

SEQ ID NO: 1357 - DNA, 46 bp, Artificial Sequence
  Synthesized adaptor oligonucleotide
  misc_feature (34)..(36): n is a, c, g, or t
tgcaggaccagagaattcgaatacagtaggttcnnngatcgacatg

SEQ ID NO: 1358 - DNA, 46 bp, Artificial Sequence
  Synthesized adaptor oligonucleotide
  misc_feature (34)..(36): n is a, c, g, or t
tgcaggaccagagaattcgaatacacttttttcnnngatcgacatg

SEQ ID NO: 1359 - DNA, 46 bp, Artificial Sequence
  Synthesized adaptor oligonucleotide
  misc_feature (34)..(36): n is a, c, g, or t
tgcaggaccagagaattcgaatacaatgacccannngatcgacatg

SEQ ID NO: 1360 - DNA, 46 bp, Artificial Sequence
  Synthesized adaptor oligonucleotide
  misc_feature (34)..(36): n is a, c, g, or t
tgcaggaccagagaattcgaatacaatcagttannngatcgacatg

SEQ ID NO: 1361 - DNA, 46 bp, Artificial Sequence
  Synthesized adaptor oligonucleotide
  misc_feature (34)..(36): n is a, c, g, or t
tgcaggaccagagaattcgaatacatagtaaagnnngatcgacatg

SEQ ID NO: 1362 - DNA, 46 bp, Artificial Sequence
  Synthesized adaptor oligonucleotide
  misc_feature (34)..(36): n is a, c, g, or t
tgcaggaccagagaattcgaatacacccgatggnnngatcgacatg

SEQ ID NO: 1363 - DNA, 46 bp, Artificial Sequence
  Synthesized adaptor oligonucleotide
  misc_feature (34)..(36): n is a, c, g, or t
tgcaggaccagagaattcgaatacacacagcatnnngatcgacatg

SEQ ID NO: 1364 - DNA, 46 bp, Artificial Sequence
  Synthesized adaptor oligonucleotide
  misc_feature (34)..(36): n is a, c, g, or t
tgcaggaccagagaattcgaatacacaggtactnnngatcgacatg

SEQ ID NO: 1365 - DNA, 46 bp, Artificial Sequence
  Synthesized adaptor oligonucleotide
  misc_feature (34)..(36): n is a, c, g, or t
tgcaggaccagagaattcgaatacacataaccgnnngatcgacatg

SEQ ID NO: 1366 - DNA, 46 bp, Artificial Sequence
  Synthesized adaptor oligonucleotide
  misc_feature (34)..(36): n is a, c, g, or t
tgcaggaccagagaattcgaatacagtactggtnnngatcgacatg

SEQ ID NO: 1367 - DNA, 46 bp, Artificial Sequence
  Synthesized adaptor oligonucleotide
  misc_feature (34)..(36): n is a, c, g, or t
tgcaggaccagagaattcgaatacagcaagtctnnngatcgacatg

SEQ ID NO: 1368 - DNA, 46 bp, Artificial Sequence
  Synthesized adaptor oligonucleotide
  misc_feature (34)..(36): n is a, c, g, or t
tgcaggaccagagaattcgaatacacgtgctccnnngatcgacatg

SEQ ID NO: 1369 - DNA, 46 bp, Artificial Sequence
  Synthesized adaptor oligonucleotide
  misc_feature (34)..(36): n is a, c, g, or t
tgcaggaccagagaattcgaatacacactacctnnngatcgacatg

SEQ ID NO: 1370 - DNA, 46 bp, Artificial Sequence
  Synthesized adaptor oligonucleotide
  misc_feature (34)..(36): n is a, c, g, or t
tgcaggaccagagaattcgaatacagtgtatatnnngatcgacatg

SEQ ID NO: 1371 - DNA, 46 bp, Artificial Sequence
  Synthesized adaptor oligonucleotide
  misc_feature (34)..(36): n is a, c, g, or t
tgcaggaccagagaattcgaatacaatgacgctnnngatcgacatg

SEQ ID NO: 1372 - DNA, 46 bp, Artificial Sequence
  Synthesized adaptor oligonucleotide
  misc_feature (34)..(36): n is a, c, g, or t
tgcaggaccagagaattcgaatacaaggcacttnnngatcgacatg

SEQ ID NO: 1373 - DNA, 46 bp, Artificial Sequence
  Synthesized adaptor oligonucleotide
  misc_feature (34)..(36): n is a, c, g, or t
tgcaggaccagagaattcgaatacaggcaggcannngatcgacatg

SEQ ID NO: 1374 - DNA, 46 bp, Artificial Sequence
  Synthesized adaptor oligonucleotide
  misc_feature (34)..(36): n is a, c, g, or t
tgcaggaccagagaattcgaatacactatgtttnnngatcgacatg

SEQ ID NO: 1375 - DNA, 46 bp, Artificial Sequence
  Synthesized adaptor oligonucleotide
  misc_feature (34)..(36): n is a, c, g, or t
tgcaggaccagagaattcgaatacataaatattnnngatcgacatg

SEQ ID NO: 1376 - DNA, 46 bp, Artificial Sequence
  Synthesized adaptor oligonucleotide
  misc_feature (34)..(36): n is a, c, g, or t
tgcaggaccagagaattcgaatacagacaccatnnngatcgacatg

SEQ ID NO: 1377 - DNA, 46 bp, Artificial Sequence
  Synthesized adaptor oligonucleotide
  misc_feature (34)..(36): n is a, c, g, or t
tgcaggaccagagaattcgaatacatagatactnnngatcgacatg

SEQ ID NO: 1378 - DNA, 46 bp, Artificial Sequence
  Synthesized adaptor oligonucleotide
  misc_feature (34)..(36): n is a, c, g, or t
tgcaggaccagagaattcgaatacataccctgtnnngatcgacatg

SEQ ID NO: 1379 - DNA, 46 bp, Artificial Sequence
  Synthesized adaptor oligonucleotide
  misc_feature (34)..(36): n is a, c, g, or t
tgcaggaccagagaattcgaatacagtcgccgannngatcgacatg

SEQ ID NO: 1380 - DNA, 46 bp, Artificial Sequence
  Synthesized adaptor oligonucleotide
  misc_feature (34)..(36): n is a, c, g, or t
tgcaggaccagagaattcgaatacacctcttagnnngatcgacatg

SEQ ID NO: 1381 - DNA, 46 bp, Artificial Sequence
  Synthesized adaptor oligonucleotide
  misc_feature (34)..(36): n is a, c, g, or t
tgcaggaccagagaattcgaatacataagattcnnngatcgacatg

SEQ ID NO: 1382 - DNA, 46 bp, Artificial Sequence
  Synthesized adaptor oligonucleotide
  misc_feature (34)..(36): n is a, c, g, or t
tgcaggaccagagaattcgaatacacgcgtacgnnngatcgacatg

SEQ ID NO: 1383 - DNA, 46 bp, Artificial Sequence
  Synthesized adaptor oligonucleotide
  misc_feature (34)..(36): n is a, c, g, or t
tgcaggaccagagaattcgaatacactgaccaannngatcgacatg

SEQ ID NO: 1384 - DNA, 46 bp, Artificial Sequence
  Synthesized adaptor oligonucleotide
  misc_feature (34)..(36): n is a, c, g, or t
tgcaggaccagagaattcgaatacaaagaccgannngatcgacatg

SEQ ID NO: 1385 - DNA, 46 bp, Artificial Sequence
  Synthesized adaptor oligonucleotide
  misc_feature (34)..(36): n is a, c, g, or t
tgcaggaccagagaattcgaatacaaatgattcnnngatcgacatg

SEQ ID NO: 1386 - DNA, 46 bp, Artificial Sequence
  Synthesized adaptor oligonucleotide
  misc_feature (34)..(36): n is a, c, g, or t
tgcaggaccagagaattcgaatacaccccccaannngatcgacatg

SEQ ID NO: 1387 - DNA, 46 bp, Artificial Sequence
  Synthesized adaptor oligonucleotide
  misc_feature (34)..(36): n is a, c, g, or t
tgcaggaccagagaattcgaatacagcctgaatnnngatcgacatg

SEQ ID NO: 1388 - DNA, 46 bp, Artificial Sequence
  Synthesized adaptor oligonucleotide
  misc_feature (34)..(36): n is a, c, g, or t
tgcaggaccagagaattcgaatacatcggtagtnnngatcgacatg

SEQ ID NO: 1389 - DNA, 46 bp, Artificial Sequence
  Synthesized adaptor oligonucleotide
  misc_feature (34)..(36): n is a, c, g, or t
tgcaggaccagagaattcgaatacatggctcggnnntgcatcaggt

SEQ ID NO: 1390 - DNA, 46 bp, Artificial Sequence
  Synthesized adaptor oligonucleotide
  misc_feature (34)..(36): n is a, c, g, or t
tgcaggaccagagaattcgaatacacaatcctcnnntgcatcaggt

SEQ ID NO: 1391 - DNA, 46 bp, Artificial Sequence
  Synthesized adaptor oligonucleotide
  misc_feature (34)..(36): n is a, c, g, or t
tgcaggaccagagaattcgaatacatagagacgnnntgcatcaggt

SEQ ID NO: 1392 - DNA, 46 bp, Artificial Sequence
  Synthesized adaptor oligonucleotide
  misc_feature (34)..(36): n is a, c, g, or t
tgcaggaccagagaattcgaatacagcggatggnnntgcatcaggt

SEQ ID NO: 1393 - DNA, 46 bp, Artificial Sequence
  Synthesized adaptor oligonucleotide
  misc_feature (34)..(36): n is a, c, g, or t
tgcaggaccagagaattcgaatacactcaccatnnntgcatcaggt

SEQ ID NO: 1394 - DNA, 46 bp, Artificial Sequence
  Synthesized adaptor oligonucleotide
  misc_feature (34)..(36): n is a, c, g, or t
tgcaggaccagagaattcgaatacaatggtaaannntgcatcaggt

SEQ ID NO: 1395 - DNA, 46 bp, Artificial Sequence
  Synthesized adaptor oligonucleotide
  misc_feature (34)..(36): n is a, c, g, or t
tgcaggaccagagaattcgaatacatatcaacannntgcatcaggt

SEQ ID NO: 1396 - DNA, 46 bp, Artificial Sequence
  Synthesized adaptor oligonucleotide
  misc_feature (34)..(36): n is a, c, g, or t
tgcaggaccagagaattcgaatacaaaagtcaannntgcatcaggt

SEQ ID NO: 1397 - DNA, 46 bp, Artificial Sequence
  Synthesized adaptor oligonucleotide
  misc_feature (34)..(36): n is a, c, g, or t
tgcaggaccagagaattcgaatacacaaaggcannntgcatcaggt

SEQ ID NO: 1398 - DNA, 46 bp, Artificial Sequence
  Synthesized adaptor oligonucleotide
  misc_feature (34)..(36): n is a, c, g, or t
tgcaggaccagagaattcgaatacacgatgactnnntgcatcaggt

SEQ ID NO: 1399 - DNA, 46 bp, Artificial Sequence
  Synthesized adaptor oligonucleotide
  misc_feature (34)..(36): n is a, c, g, or t
tgcaggaccagagaattcgaatacacgattgtgnnntgcatcaggt

SEQ ID NO: 1400 - DNA, 46 bp, Artificial Sequence
  Synthesized adaptor oligonucleotide
  misc_feature (34)..(36): n is a, c, g, or t
tgcaggaccagagaattcgaatacattatcttgnnntgcatcaggt

SEQ ID NO: 1401 - DNA, 46 bp, Artificial Sequence
  Synthesized adaptor oligonucleotide
  misc_feature (34)..(36): n is a, c, g, or t
tgcaggaccagagaattcgaatacagtattgatnnntgcatcaggt

SEQ ID NO: 1402 - DNA, 46 bp, Artificial Sequence
  Synthesized adaptor oligonucleotide
  misc_feature (34)..(36): n is a, c, g, or t
tgcaggaccagagaattcgaatacaaggaggttnnntgcatcaggt

SEQ ID NO: 1403 - DNA, 46 bp, Artificial Sequence
  Synthesized adaptor oligonucleotide
  misc_feature (34)..(36): n is a, c, g, or t
tgcaggaccagagaattcgaatacaactgccccnnntgcatcaggt

SEQ ID NO: 1404 - DNA, 46 bp, Artificial Sequence
  Synthesized adaptor oligonucleotide
  misc_feature (34)..(36): n is a, c, g, or t
tgcaggaccagagaattcgaatacaaaatctcannntgcatcaggt

SEQ ID NO: 1405 - DNA, 46 bp, Artificial Sequence
  Synthesized adaptor oligonucleotide
  misc_feature (34)..(36): n is a, c, g, or t
tgcaggaccagagaattcgaatacaccatgtgannntgcatcaggt

SEQ ID NO: 1406 - DNA, 46 bp, Artificial Sequence
  Synthesized adaptor oligonucleotide
  misc_feature (34)..(36): n is a, c, g, or t
tgcaggaccagagaattcgaatacaccccttttnnntgcatcaggt

SEQ ID NO: 1407 - DNA, 46 bp, Artificial Sequence
  Synthesized adaptor oligonucleotide
  misc_feature (34)..(36): n is a, c, g, or t
tgcaggaccagagaattcgaatacagctagcgcnnntgcatcaggt

SEQ ID NO: 1408 - DNA, 46 bp, Artificial Sequence
  Synthesized adaptor oligonucleotide
  misc_feature (34)..(36): n is a, c, g, or t
tgcaggaccagagaattcgaatacaaacaccgtnnntgcatcaggt

SEQ ID NO: 1409 - DNA, 46 bp, Artificial Sequence
  Synthesized adaptor oligonucleotide
  misc_feature (34)..(36): n is a, c, g, or t
tgcaggaccagagaattcgaatacactgagatcnnntgcatcaggt

SEQ ID NO: 1410 - DNA, 46 bp, Artificial Sequence
  Synthesized adaptor oligonucleotide
  misc_feature (34)..(36): n is a, c, g, or t
tgcaggaccagagaattcgaatacaaatgcgtcnnntgcatcaggt

SEQ ID NO: 1411 - DNA, 46 bp, Artificial Sequence
  Synthesized adaptor oligonucleotide
  misc_feature (34)..(36): n is a, c, g, or t
tgcaggaccagagaattcgaatacaattgccagnnntgcatcaggt

SEQ ID NO: 1412 - DNA, 46 bp, Artificial Sequence
  Synthesized adaptor oligonucleotide
  misc_feature (34)..(36): n is a, c, g, or t
tgcaggaccagagaattcgaatacattaattccnnntgcatcaggt

SEQ ID NO: 1413 - DNA, 46 bp, Artificial Sequence
  Synthesized adaptor oligonucleotide
  misc_feature (34)..(36): n is a, c, g, or t
tgcaggaccagagaattcgaatacaagcatattnnntgcatcaggt

SEQ ID NO: 1414 - DNA, 46 bp, Artificial Sequence
  Synthesized adaptor oligonucleotide
  misc_feature (34)..(36): n is a, c, g, or t
tgcaggaccagagaattcgaatacacccattacnnntgcatcaggt

SEQ ID NO: 1415 - DNA, 46 bp, Artificial Sequence
  Synthesized adaptor oligonucleotide
  misc_feature (34)..(36): n is a, c, g, or t
tgcaggaccagagaattcgaatacactcgtttgnnntgcatcaggt

SEQ ID NO: 1416 - DNA, 46 bp, Artificial Sequence
  Synthesized adaptor oligonucleotide
  misc_feature (34)..(36): n is a, c, g, or t
tgcaggaccagagaattcgaatacaggtatcgtnnntgcatcaggt

SEQ ID NO: 1417 - DNA, 46 bp, Artificial Sequence
  Synthesized adaptor oligonucleotide
  misc_feature (34)..(36): n is a, c, g, or t
tgcaggaccagagaattcgaatacagtacccttnnntgcatcaggt

SEQ ID NO: 1418 - DNA, 46 bp, Artificial Sequence
  Synthesized adaptor oligonucleotide
  misc_feature (34)..(36): n is a, c, g, or t
tgcaggaccagagaattcgaatacacaacttttnnntgcatcaggt

SEQ ID NO: 1419 - DNA, 46 bp, Artificial Sequence
  Synthesized adaptor oligonucleotide
  misc_feature (34)..(36): n is a, c, g, or t
tgcaggaccagagaattcgaatacagaacttgcnnntgcatcaggt

SEQ ID NO: 1420 - DNA, 46 bp, Artificial Sequence
  Synthesized adaptor oligonucleotide
  misc_feature (34)..(36): n is a, c, g, or t
tgcaggaccagagaattcgaatacatattatggnnntgcatcaggt

SEQ ID NO: 1421 - DNA, 46 bp, Artificial Sequence
  Synthesized adaptor oligonucleotide
  misc_feature (34)..(36): n is a, c, g, or t
tgcaggaccagagaattcgaatacagcccgcggnnntgcatcaggt

SEQ ID NO: 1422 - DNA, 46 bp, Artificial Sequence
  Synthesized adaptor oligonucleotide
  misc_feature (34)..(36): n is a, c, g, or t
tgcaggaccagagaattcgaatacagcaaaagcnnntgcatcaggt

SEQ ID NO: 1423 - DNA, 46 bp, Artificial Sequence
  Synthesized adaptor oligonucleotide
  misc_feature (34)..(36): n is a, c, g, or t
tgcaggaccagagaattcgaatacagatacgctnnntgcatcaggt

SEQ ID NO: 1424 - DNA, 46 bp, Artificial Sequence
  Synthesized adaptor oligonucleotide
  misc_feature (34)..(36): n is a, c, g, or t
tgcaggaccagagaattcgaatacacagtatcgnnntgcatcaggt

SEQ ID NO: 1425 - DNA, 46 bp, Artificial Sequence
  Synthesized adaptor oligonucleotide
  misc_feature (34)..(36): n is a, c, g, or t
tgcaggaccagagaattcgaatacactcactgtnnntgcatcaggt

SEQ ID NO: 1426 - DNA, 46 bp, Artificial Sequence
  Synthesized adaptor oligonucleotide
  misc_feature (34)..(36): n is a, c, g, or t
tgcaggaccagagaattcgaatacaccgtcaggnnntgcatcaggt

SEQ ID NO: 1427 - DNA, 46 bp, Artificial Sequence
  Synthesized adaptor oligonucleotide
  misc_feature (34)..(36): n is a, c, g, or t
tgcaggaccagagaattcgaatacagcttctgtnnntgcatcaggt

SEQ ID NO: 1428 - DNA, 46 bp, Artificial Sequence
  Synthesized adaptor oligonucleotide
  misc_feature (34)..(36): n is a, c, g, or t
tgcaggaccagagaattcgaatacattatatttnnntgcatcaggt

SEQ ID NO: 1429 - DNA, 46 bp, Artificial Sequence
  Synthesized adaptor oligonucleotide
  misc_feature (34)..(36): n is a, c, g, or t
tgcaggaccagagaattcgaatacaggtttacgnnntgcatcaggt

SEQ ID NO: 1430 - DNA, 46 bp, Artificial Sequence
  Synthesized adaptor oligonucleotide
  misc_feature (34)..(36): n is a, c, g, or t
tgcaggaccagagaattcgaatacaggacgatannntgcatcaggt

SEQ ID NO: 1431 - DNA, 46 bp, Artificial Sequence
  Synthesized adaptor oligonucleotide
  misc_feature (34)..(36): n is a, c, g, or t
tgcaggaccagagaattcgaatacaagtcaggannntgcatcaggt

SEQ ID NO: 1432 - DNA, 46 bp, Artificial Sequence
  Synthesized adaptor oligonucleotide
  misc_feature (34)..(36): n is a, c, g, or t
tgcaggaccagagaattcgaatacactacgaacnnntgcatcaggt

SEQ ID NO: 1433 - DNA, 46 bp, Artificial Sequence
  Synthesized adaptor oligonucleotide
  misc_feature (34)..(36): n is a, c, g, or t
tgcaggaccagagaattcgaatacaagccatgtnnntgcatcaggt

SEQ ID NO: 1434 - DNA, 46 bp, Artificial Sequence
  Synthesized adaptor oligonucleotide
  misc_feature (34)..(36): n is a, c, g, or t
tgcaggaccagagaattcgaatacattccactgnnntgcatcaggt

SEQ ID NO: 1435 - DNA, 46 bp, Artificial Sequence
  Synthesized adaptor oligonucleotide
  misc_feature (34)..(36): n is a, c, g, or t
tgcaggaccagagaattcgaatacaaccctgttnnntgcatcaggt

SEQ ID NO: 1436 - DNA, 46 bp, Artificial Sequence
  Synthesized adaptor oligonucleotide
  misc_feature (34)..(36): n is a, c, g, or t
tgcaggaccagagaattcgaatacaccctttctnnntgcatcaggt

SEQ ID NO: 1437 - DNA, 46 bp, Artificial Sequence
  Synthesized adaptor oligonucleotide
  misc_feature (34)..(36): n is a, c, g, or t
tgcaggaccagagaattcgaatacaatgttgatnnntgcatcaggt

SEQ ID NO: 1438 - DNA, 46 bp, Artificial Sequence
  Synthesized adaptor oligonucleotide
  misc_feature (34)..(36): n is a, c, g, or t
tgcaggaccagagaattcgaatacacactggcgnnntgcatcaggt

SEQ ID NO: 1439 - DNA, 46 bp, Artificial Sequence
  Synthesized adaptor oligonucleotide
  misc_feature (34)..(36): n is a, c, g, or t
tgcaggaccagagaattcgaatacattcggtagnnntgcatcaggt

SEQ ID NO: 1440 - DNA, 46 bp, Artificial Sequence
  Synthesized adaptor oligonucleotide
  misc_feature (34)..(36): n is a, c, g, or t
tgcaggaccagagaattcgaatacaaccctgccnnntgcatcaggt

SEQ ID NO: 1441 - DNA, 46 bp, Artificial Sequence
  Synthesized adaptor oligonucleotide
  misc_feature (34)..(36): n is a, c, g, or t
tgcaggaccagagaattcgaatacagtacctagnnntgcatcaggt

SEQ ID NO: 1442 - DNA, 46 bp, Artificial Sequence
  Synthesized adaptor oligonucleotide
  misc_feature (34)..(36): n is a, c, g, or t
tgcaggaccagagaattcgaatacacgataattnnntgcatcaggt

SEQ ID NO: 1443 - DNA, 46 bp, Artificial Sequence
  Synthesized adaptor oligonucleotide
  misc_feature (34)..(36): n is a, c, g, or t
tgcaggaccagagaattcgaatacagccaaccgnnntgcatcaggt

SEQ ID NO: 1444 - DNA, 46 bp, Artificial Sequence
  Synthesized adaptor oligonucleotide
  misc_feature (34)..(36): n is a, c, g, or t
tgcaggaccagagaattcgaatacataacatcannntgcatcaggt

SEQ ID NO: 1445 - DNA, 46 bp, Artificial Sequence
  Synthesized adaptor oligonucleotide
  misc_feature (34)..(36): n is a, c, g, or t
tgcaggaccagagaattcgaatacagcaagaacnnntgcatcaggt

SEQ ID NO: 1446 - DNA, 46 bp, Artificial Sequence
  Synthesized adaptor oligonucleotide
  misc_feature (34)..(36): n is a, c, g, or t
tgcaggaccagagaattcgaatacaacgtgatcnnntgcatcaggt

SEQ ID NO: 1447 - DNA, 46 bp, Artificial Sequence
  Synthesized adaptor oligonucleotide
  misc_feature (34)..(36): n is a, c, g, or t
tgcaggaccagagaattcgaatacacgttcctannntgcatcaggt

SEQ ID NO: 1448 - DNA, 46 bp, Artificial Sequence
  Synthesized adaptor oligonucleotide
  misc_feature (34)..(36): n is a, c, g, or t
tgcaggaccagagaattcgaatacaatgccagtnnntgcatcaggt

SEQ ID NO: 1449 - DNA, 46 bp, Artificial Sequence
  Synthesized adaptor oligonucleotide
  misc_feature (34)..(36): n is a, c, g, or t
tgcaggaccagagaattcgaatacacaggctcgnnnacgtatgcca

SEQ ID NO: 1450 - DNA, 46 bp, Artificial Sequence
  Synthesized adaptor oligonucleotide
  misc_feature (34)..(36): n is a, c, g, or t
tgcaggaccagagaattcgaatacattgaagccnnnacgtatgcca

SEQ ID NO: 1451 - DNA, 46 bp, Artificial Sequence
  Synthesized adaptor oligonucleotide
  misc_feature (34)..(36): n is a, c, g, or t
tgcaggaccagagaattcgaatacacacagagannnacgtatgcca

SEQ ID NO: 1452 - DNA, 46 bp, Artificial Sequence
  Synthesized adaptor oligonucleotide
  misc_feature (34)..(36): n is a, c, g, or t
tgcaggaccagagaattcgaatacaggactccgnnnacgtatgcca

SEQ ID NO: 1453 - DNA, 46 bp, Artificial Sequence
  Synthesized adaptor oligonucleotide
  misc_feature (34)..(36): n is a, c, g, or t
tgcaggaccagagaattcgaatacattggttaannnacgtatgcca

SEQ ID NO: 1454 - DNA, 46 bp, Artificial Sequence
  Synthesized adaptor oligonucleotide
  misc_feature (34)..(36): n is a, c, g, or t
tgcaggaccagagaattcgaatacatactaacannnacgtatgcca

SEQ ID NO: 1455 - DNA, 46 bp, Artificial Sequence
  Synthesized adaptor oligonucleotide
  misc_feature (34)..(36): n is a, c, g, or t
tgcaggaccagagaattcgaatacagtccaatgnnnacgtatgcca

SEQ ID NO: 1456 - DNA, 46 bp, Artificial Sequence
  Synthesized adaptor oligonucleotide
  misc_feature (34)..(36): n is a, c, g, or t
tgcaggaccagagaattcgaatacaaggcacggnnnacgtatgcca

SEQ ID NO: 1457 - DNA, 46 bp, Artificial Sequence
  Synthesized adaptor oligonucleotide
  misc_feature (34)..(36): n is a, c, g, or t
tgcaggaccagagaattcgaatacaatcatgtannnacgtatgcca

SEQ ID NO: 1458 - DNA, 46 bp, Artificial Sequence
  Synthesized adaptor oligonucleotide
  misc_feature (34)..(36): n is a, c, g, or t
tgcaggaccagagaattcgaatacaaaaaggttnnnacgtatgcca

SEQ ID NO: 1459 - DNA, 46 bp, Artificial Sequence
  Synthesized adaptor oligonucleotide
  misc_feature (34)..(36): n is a, c, g, or t
tgcaggaccagagaattcgaatacaaggcacccnnnacgtatgcca

SEQ ID NO: 1460 - DNA, 46 bp, Artificial Sequence
  Synthesized adaptor oligonucleotide
  misc_feature (34)..(36): n is a, c, g, or t
tgcaggaccagagaattcgaatacattgaaagannnacgtatgcca

SEQ ID NO: 1461 - DNA, 46 bp, Artificial Sequence
  Synthesized adaptor oligonucleotide
  misc_feature (34)..(36): n is a, c, g, or t
tgcaggaccagagaattcgaatacactcgacttnnnacgtatgcca

SEQ ID NO: 1462 - DNA, 46 bp, Artificial Sequence
  Synthesized adaptor oligonucleotide
  misc_feature (34)..(36): n is a, c, g, or t
tgcaggaccagagaattcgaatacagcgaattcnnnacgtatgcca

SEQ ID NO: 1463 - DNA, 46 bp, Artificial Sequence
  Synthesized adaptor oligonucleotide
  misc_feature (34)..(36): n is a, c, g, or t
tgcaggaccagagaattcgaatacacccccgcgnnnacgtatgcca

SEQ ID NO: 1464 - DNA, 46 bp, Artificial Sequence
  Synthesized adaptor oligonucleotide
  misc_feature (34)..(36): n is a, c, g, or t
tgcaggaccagagaattcgaatacagataagcgnnnacgtatgcca

SEQ ID NO: 1465 - DNA, 46 bp, Artificial Sequence
  Synthesized adaptor oligonucleotide
  misc_feature (34)..(36): n is a, c, g, or t
tgcaggaccagagaattcgaatacagaacgatgnnnacgtatgcca

SEQ ID NO: 1466 - DNA, 46 bp, Artificial Sequence
  Synthesized adaptor oligonucleotide
  misc_feature (34)..(36): n is a, c, g, or t
tgcaggaccagagaattcgaatacaaatattatnnnacgtatgcca

SEQ ID NO: 1467 - DNA, 46 bp, Artificial Sequence
  Synthesized adaptor oligonucleotide
  misc_feature (34)..(36): n is a, c, g, or t
tgcaggaccagagaattcgaatacataagctatnnnacgtatgcca

SEQ ID NO: 1468 - DNA, 46 bp, Artificial Sequence
  Synthesized adaptor oligonucleotide
  misc_feature (34)..(36): n is a, c, g, or t
tgcaggaccagagaattcgaatacaactcggcgnnnacgtatgcca

SEQ ID NO: 1469 - DNA, 46 bp, Artificial Sequence
  Synthesized adaptor oligonucleotide
  misc_feature (34)..(36): n is a, c, g, or t
tgcaggaccagagaattcgaatacacgactgcgnnnacgtatgcca

SEQ ID NO: 1470 - DNA, 46 bp, Artificial Sequence
  Synthesized adaptor oligonucleotide
  misc_feature (34)..(36): n is a, c, g, or t
tgcaggaccagagaattcgaatacatccgacttnnnacgtatgcca

SEQ ID NO: 1471 - DNA, 46 bp, Artificial Sequence
  Synthesized adaptor oligonucleotide
  misc_feature (34)..(36): n is a, c, g, or t
tgcaggaccagagaattcgaatacaggaggaggnnnacgtatgcca

SEQ ID NO: 1472 - DNA, 46 bp, Artificial Sequence
  Synthesized adaptor oligonucleotide
  misc_feature (34)..(36): n is a, c, g, or t
tgcaggaccagagaattcgaatacacaggcaggnnnacgtatgcca

SEQ ID NO: 1473 - DNA, 46 bp, Artificial Sequence
  Synthesized adaptor oligonucleotide
  misc_feature (34)..(36): n is a, c, g, or t
tgcaggaccagagaattcgaatacaatctcattnnnacgtatgcca

SEQ ID NO: 1474 - DNA, 46 bp, Artificial Sequence
  Synthesized adaptor oligonucleotide
  misc_feature (34)..(36): n is a, c, g, or t
tgcaggaccagagaattcgaatacaaggcgatannnacgtatgcca

SEQ ID NO: 1475 - DNA, 46 bp, Artificial Sequence
  Synthesized adaptor oligonucleotide
  misc_feature (34)..(36): n is a, c, g, or t
tgcaggaccagagaattcgaatacacctagatgnnnacgtatgcca

SEQ ID NO: 1476 - DNA, 46 bp, Artificial Sequence
  Synthesized adaptor oligonucleotide
  misc_feature (34)..(36): n is a, c, g, or t
tgcaggaccagagaattcgaatacacctaccatnnnacgtatgcca

SEQ ID NO: 1477 - DNA, 46 bp, Artificial Sequence
  Synthesized adaptor oligonucleotide
  misc_feature (34)..(36): n is a, c, g, or t
tgcaggaccagagaattcgaatacaaacgtccannnacgtatgcca

SEQ ID NO: 1478 - DNA, 46 bp, Artificial Sequence
  Synthesized adaptor oligonucleotide
  misc_feature (34)..(36): n is a, c, g, or t
tgcaggaccagagaattcgaatacagcacttagnnnacgtatgcca

SEQ ID NO: 1479 - DNA, 46 bp, Artificial Sequence
  Synthesized adaptor oligonucleotide
  misc_feature (34)..(36): n is a, c, g, or t
tgcaggaccagagaattcgaatacagatcggaannnacgtatgcca

SEQ ID NO: 1480 - DNA, 46 bp, Artificial Sequence
  Synthesized adaptor oligonucleotide
  misc_feature (34)..(36): n is a, c, g, or t
tgcaggaccagagaattcgaatacacgccataannnacgtatgcca

SEQ ID NO: 1481 - DNA, 46 bp, Artificial Sequence
  Synthesized adaptor oligonucleotide
  misc_feature (34)..(36): n is a, c, g, or t
tgcaggaccagagaattcgaatacattaagttgnnnacgtatgcca

SEQ ID NO: 1482 - DNA, 46 bp, Artificial Sequence
  Synthesized adaptor oligonucleotide
  misc_feature (34)..(36): n is a, c, g, or t
tgcaggaccagagaattcgaatacagccagctgnnnacgtatgcca

SEQ ID NO: 1483 - DNA, 46 bp, Artificial Sequence
  Synthesized adaptor oligonucleotide
  misc_feature (34)..(36): n is a, c, g, or t
tgcaggaccagagaattcgaatacaaaacgcctnnnacgtatgcca

SEQ ID NO: 1484 - DNA, 46 bp, Artificial Sequence
  Synthesized adaptor oligonucleotide
  misc_feature (34)..(36): n is a, c, g, or t
tgcaggaccagagaattcgaatacagtatttctnnnacgtatgcca

SEQ ID NO: 1485 - DNA, 46 bp, Artificial Sequence
  Synthesized adaptor oligonucleotide
  misc_feature (34)..(36): n is a, c, g, or t
tgcaggaccagagaattcgaatacaggtctcccnnnacgtatgcca

SEQ ID NO: 1486 - DNA, 46 bp, Artificial Sequence
  Synthesized adaptor oligonucleotide
  misc_feature (34)..(36): n is a, c, g, or t
tgcaggaccagagaattcgaatacacaagtctgnnnacgtatgcca

SEQ ID NO: 1487 - DNA, 46 bp, Artificial Sequence
  Synthesized adaptor oligonucleotide
  misc_feature (34)..(36): n is a, c, g, or t
tgcaggaccagagaattcgaatacagagcacaannnacgtatgcca

SEQ ID NO: 1488 - DNA, 46 bp, Artificial Sequence
  Synthesized adaptor oligonucleotide
  misc_feature (34)..(36): n is a, c, g, or t
tgcaggaccagagaattcgaatacatcaaaccgnnnacgtatgcca

SEQ ID NO: 1489 - DNA, 46 bp, Artificial Sequence
  Synthesized adaptor oligonucleotide
  misc_feature (34)..(36): n is a, c, g, or t
tgcaggaccagagaattcgaatacattccgctannnacgtatgcca

SEQ ID NO: 1490 - DNA, 46 bp, Artificial Sequence
  Synthesized adaptor oligonucleotide
  misc_feature (34)..(36): n is a, c, g, or t
tgcaggaccagagaattcgaatacaattgcacgnnnacgtatgcca

SEQ ID NO: 1491 - DNA, 46 bp, Artificial Sequence
  Synthesized adaptor oligonucleotide
  misc_feature (34)..(36): n is a, c, g, or t
tgcaggaccagagaattcgaatacaatacctaannnacgtatgcca

SEQ ID NO: 1492 - DNA, 46 bp, Artificial Sequence
  Synthesized adaptor oligonucleotide
  misc_feature (34)..(36): n is a, c, g, or t
tgcaggaccagagaattcgaatacaggaccggannnacgtatgcca

SEQ ID NO: 1493 - DNA, 46 bp, Artificial Sequence
  Synthesized adaptor oligonucleotide
  misc_feature (34)..(36): n is a, c, g, or t
tgcaggaccagagaattcgaatacatgtcccgcnnnacgtatgcca

SEQ ID NO: 1494 - DNA, 46 bp, Artificial Sequence
  Synthesized adaptor oligonucleotide
  misc_feature (34)..(36): n is a, c, g, or t
tgcaggaccagagaattcgaatacagccccagannnacgtatgcca

SEQ ID NO: 1495 - DNA, 46 bp, Artificial Sequence
  Synthesized adaptor oligonucleotide
  misc_feature (34)..(36): n is a, c, g, or t
tgcaggaccagagaattcgaatacacaagcccgnnnacgtatgcca

SEQ ID NO: 1496 - DNA, 46 bp, Artificial Sequence
  Synthesized adaptor oligonucleotide
  misc_feature (34)..(36): n is a, c, g, or t
tgcaggaccagagaattcgaatacagccattgannnacgtatgcca

SEQ ID NO: 1497 - DNA, 46 bp, Artificial Sequence
  Synthesized adaptor oligonucleotide
  misc_feature (34)..(36): n is a, c, g, or t
tgcaggaccagagaattcgaatacatgaacaccnnnacgtatgcca

SEQ ID NO: 1498 - DNA, 46 bp, Artificial Sequence
  Synthesized adaptor oligonucleotide
  misc_feature (34)..(36): n is a, c, g, or t
tgcaggaccagagaattcgaatacagaatccgtnnnacgtatgcca

SEQ ID NO: 1499 - DNA, 46 bp, Artificial Sequence
  Synthesized adaptor oligonucleotide
  misc_feature (34)..(36): n is a, c, g, or t
tgcaggaccagagaattcgaatacattaatcgannnacgtatgcca

SEQ ID NO: 1500 - DNA, 46 bp, Artificial Sequence
  Synthesized adaptor oligonucleotide
  misc_feature (34)..(36): n is a, c, g, or t
tgcaggaccagagaattcgaatacacgccactcnnnacgtatgcca

SEQ ID NO: 1501 - DNA, 46 bp, Artificial Sequence
  Synthesized adaptor oligonucleotide
  misc_feature (34)..(36): n is a, c, g, or t
tgcaggaccagagaattcgaatacacccttagtnnnacgtatgcca

SEQ ID NO: 1502 - DNA, 46 bp, Artificial Sequence
  Synthesized adaptor oligonucleotide
  misc_feature (34)..(36): n is a, c, g, or t
tgcaggaccagagaattcgaatacatttcctggnnnacgtatgcca

SEQ ID NO: 1503 - DNA, 46 bp, Artificial Sequence
  Synthesized adaptor oligonucleotide
  misc_feature (34)..(36): n is a, c, g, or t
tgcaggaccagagaattcgaatacattcaacggnnnacgtatgcca

SEQ ID NO: 1504 - DNA, 46 bp, Artificial Sequence
  Synthesized adaptor oligonucleotide
  misc_feature (34)..(36): n is a, c, g, or t
tgcaggaccagagaattcgaatacattgaggagnnnacgtatgcca

SEQ ID NO: 1505 - DNA, 46 bp, Artificial Sequence
  Synthesized adaptor oligonucleotide
  misc_feature (34)..(36): n is a, c, g, or t
tgcaggaccagagaattcgaatacattcacgctnnnacgtatgcca

SEQ ID NO: 1506 - DNA, 46 bp, Artificial Sequence
  Synthesized adaptor oligonucleotide
  misc_feature (34)..(36): n is a, c, g, or t
tgcaggaccagagaattcgaatacatcgcggtgnnnacgtatgcca

SEQ ID NO: 1507 - DNA, 46 bp, Artificial Sequence
  Synthesized adaptor oligonucleotide
  misc_feature (34)..(36): n is a, c, g, or t
tgcaggaccagagaattcgaatacaaattccggnnnacgtatgcca

SEQ ID NO: 1508 - DNA, 46 bp, Artificial Sequence
  Synthesized adaptor oligonucleotide
  misc_feature (34)..(36): n is a, c, g, or t
tgcaggaccagagaattcgaatacacgtcatgannnacgtatgcca

SEQ ID NO: 1509 - DNA, 46 bp, Artificial Sequence
  Synthesized adaptor oligonucleotide
  misc_feature (34)..(36): n is a, c, g, or t
tgcaggaccagagaattcgaatacacgtttattnnnctagcgttac

SEQ ID NO: 1510 - DNA, 46 bp, Artificial Sequence
  Synthesized adaptor oligonucleotide
  misc_feature (34)..(36): n is a, c, g, or t
tgcaggaccagagaattcgaatacactgcacggnnnctagcgttac

SEQ ID NO: 1511 - DNA, 46 bp, Artificial Sequence
  Synthesized adaptor oligonucleotide
  misc_feature (34)..(36): n is a, c, g, or t
tgcaggaccagagaattcgaatacaaccttgtcnnnctagcgttac

SEQ ID NO: 1512 - DNA, 46 bp, Artificial Sequence
  Synthesized adaptor oligonucleotide
  misc_feature (34)..(36): n is a, c, g, or t
tgcaggaccagagaattcgaatacatccacccgnnnctagcgttac

SEQ ID NO: 1513 - DNA, 46 bp, Artificial Sequence
  Synthesized adaptor oligonucleotide
  misc_feature (34)..(36): n is a, c, g, or t
tgcaggaccagagaattcgaatacaaaggccggnnnctagcgttac

SEQ ID NO: 1514 - DNA, 46 bp, Artificial Sequence
  Synthesized adaptor oligonucleotide
  misc_feature (34)..(36): n is a, c, g, or t
tgcaggaccagagaattcgaatacaggcaatagnnnctagcgttac

SEQ ID NO: 1515 - DNA, 46 bp, Artificial Sequence
  Synthesized adaptor oligonucleotide
  misc_feature (34)..(36): n is a, c, g, or t
tgcaggaccagagaattcgaatacacgctagcgnnnctagcgttac

SEQ ID NO: 1516 - DNA, 46 bp, Artificial Sequence
  Synthesized adaptor oligonucleotide
  misc_feature (34)..(36): n is a, c, g, or t
tgcaggaccagagaattcgaatacatgttctatnnnctagcgttac

SEQ ID NO: 1517 - DNA, 46 bp, Artificial Sequence
  Synthesized adaptor oligonucleotide
  misc_feature (34)..(36): n is a, c, g, or t
tgcaggaccagagaattcgaatacattaatatannnctagcgttac

SEQ ID NO: 1518 - DNA, 46 bp, Artificial Sequence
  Synthesized adaptor oligonucleotide
  misc_feature (34)..(36): n is a, c, g, or t
tgcaggaccagagaattcgaatacaatatggttnnnctagcgttac

SEQ ID NO: 1519 - DNA, 46 bp, Artificial Sequence
  Synthesized adaptor oligonucleotide
  misc_feature (34)..(36): n is a, c, g, or t
tgcaggaccagagaattcgaatacagctggttannnctagcgttac

SEQ ID NO: 1520 - DNA, 46 bp, Artificial Sequence
  Synthesized adaptor oligonucleotide
  misc_feature (34)..(36): n is a, c, g, or t
tgcaggaccagagaattcgaatacaagactgagnnnctagcgttac

SEQ ID NO: 1521 - DNA, 46 bp, Artificial Sequence
  Synthesized adaptor oligonucleotide
  misc_feature (34)..(36): n is a, c, g, or t
tgcaggaccagagaattcgaatacagacttgcannnctagcgttac

SEQ ID NO: 1522 - DNA, 46 bp, Artificial Sequence
  Synthesized adaptor oligonucleotide
  misc_feature (34)..(36): n is a, c, g, or t
tgcaggaccagagaattcgaatacagtctatccnnnctagcgttac

SEQ ID NO: 1523 - DNA, 46 bp, Artificial Sequence
  Synthesized adaptor oligonucleotide
  misc_feature (34)..(36): n is a, c, g, or t
tgcaggaccagagaattcgaatacaagctatcgnnnctagcgttac

SEQ ID NO: 1524 - DNA, 46 bp, Artificial Sequence
  Synthesized adaptor oligonucleotide
  misc_feature (34)..(36): n is a, c, g, or t
tgcaggaccagagaattcgaatacaggcgaacgnnnctagcgttac

SEQ ID NO: 1525 - DNA, 46 bp, Artificial Sequence
  Synthesized adaptor oligonucleotide
  misc_feature (34)..(36): n is a, c, g, or t
tgcaggaccagagaattcgaatacaacgaatggnnnctagcgttac

SEQ ID NO: 1526 - DNA, 46 bp, Artificial Sequence
  Synthesized adaptor oligonucleotide
  misc_feature (34)..(36): n is a, c, g, or t
tgcaggaccagagaattcgaatacatcatgctcnnnctagcgttac

SEQ ID NO: 1527 - DNA, 46 bp, Artificial Sequence
  Synthesized adaptor oligonucleotide
  misc_feature (34)..(36): n is a, c, g, or t
tgcaggaccagagaattcgaatacattgcttatnnnctagcgttac

SEQ ID NO: 1528 - DNA, 46 bp, Artificial Sequence
  Synthesized adaptor oligonucleotide
  misc_feature (34)..(36): n is a, c, g, or t
tgcaggaccagagaattcgaatacaaagccagannnctagcgttac

SEQ ID NO: 1529 - DNA, 46 bp, Artificial Sequence
  Synthesized adaptor oligonucleotide
  misc_feature (34)..(36): n is a, c, g, or t
tgcaggaccagagaattcgaatacagcagctcgnnnctagcgttac

SEQ ID NO: 1530 - DNA, 46 bp, Artificial Sequence
  Synthesized adaptor oligonucleotide
  misc_feature (34)..(36): n is a, c, g, or t
tgcaggaccagagaattcgaatacaccgagtcgnnnctagcgttac

SEQ ID NO: 1531 - DNA, 46 bp, Artificial Sequence
  Synthesized adaptor oligonucleotide
  misc_feature (34)..(36): n is a, c, g, or t
tgcaggaccagagaattcgaatacaaacagacgnnnctagcgttac

SEQ ID NO: 1532 - DNA, 46 bp, Artificial Sequence
  Synthesized adaptor oligonucleotide
  misc_feature (34)..(36): n is a, c, g, or t
tgcaggaccagagaattcgaatacacccaaacannnctagcgttac

SEQ ID NO: 1533 - DNA, 46 bp, Artificial Sequence
  Synthesized adaptor oligonucleotide
  misc_feature (34)..(36): n is a, c, g, or t
tgcaggaccagagaattcgaatacaaaggcgatnnnctagcgttac

SEQ ID NO: 1534 - DNA, 46 bp, Artificial Sequence
  Synthesized adaptor oligonucleotide
  misc_feature (34)..(36): n is a, c, g, or t
tgcaggaccagagaattcgaatacaccttaaaannnctagcgttac

SEQ ID NO: 1535 - DNA, 46 bp, Artificial Sequence
  Synthesized adaptor oligonucleotide
  misc_feature (34)..(36): n is a, c, g, or t
tgcaggaccagagaattcgaatacacatacctcnnnctagcgttac

SEQ ID NO: 1536 - DNA, 46 bp, Artificial Sequence
  Synthesized adaptor oligonucleotide
  misc_feature (34)..(36): n is a, c, g, or t
tgcaggaccagagaattcgaatacagccaatcannnctagcgttac

SEQ ID NO: 1537 - DNA, 46 bp, Artificial Sequence
  Synthesized adaptor oligonucleotide
  misc_feature (34)..(36): n is a, c, g, or t
tgcaggaccagagaattcgaatacacttaggcannnctagcgttac

SEQ ID NO: 1538 - DNA, 46 bp, Artificial Sequence
  Synthesized adaptor oligonucleotide
  misc_feature (34)..(36): n is a, c, g, or t
tgcaggaccagagaattcgaatacacgcaccagnnnctagcgttac

SEQ ID NO: 1539 - DNA, 46 bp, Artificial Sequence
  Synthesized adaptor oligonucleotide
  misc_feature (34)..(36): n is a, c, g, or t
tgcaggaccagagaattcgaatacattcccgtannnctagcgttac

SEQ ID NO: 1540 - DNA, 46 bp, Artificial Sequence
  Synthesized adaptor oligonucleotide
  misc_feature (34)..(36): n is a, c, g, or t
tgcaggaccagagaattcgaatacattcagaatnnnctagcgttac

SEQ ID NO: 1541 - DNA, 46 bp, Artificial Sequence
  Synthesized adaptor oligonucleotide
  misc_feature (34)..(36): n is a, c, g, or t
tgcaggaccagagaattcgaatacaggcattacnnnctagcgttac

SEQ ID NO: 1542 - DNA, 46 bp, Artificial Sequence
  Synthesized adaptor oligonucleotide
  misc_feature (34)..(36): n is a, c, g, or t
tgcaggaccagagaattcgaatacaaaccaaaannnctagcgttac

SEQ ID NO: 1543 - DNA, 46 bp, Artificial Sequence
  Synthesized adaptor oligonucleotide
  misc_feature (34)..(36): n is a, c, g, or t
tgcaggaccagagaattcgaatacaacgctgtannnctagcgttac

SEQ ID NO: 1544 - DNA, 46 bp, Artificial Sequence
  Synthesized adaptor oligonucleotide
  misc_feature (34)..(36): n is a, c, g, or t
tgcaggaccagagaattcgaatacaacgatctgnnnctagcgttac

SEQ ID NO: 1545 - DNA, 46 bp, Artificial Sequence
  Synthesized adaptor oligonucleotide
  misc_feature (34)..(36): n is a, c, g, or t
tgcaggaccagagaattcgaatacagcatgagannnctagcgttac

SEQ ID NO: 1546 - DNA, 46 bp, Artificial Sequence
  Synthesized adaptor oligonucleotide
  misc_feature (34)..(36): n is a, c, g, or t
tgcaggaccagagaattcgaatacagtaagtccnnnctagcgttac

SEQ ID NO: 1547 - DNA, 46 bp, Artificial Sequence
  Synthesized adaptor oligonucleotide
  misc_feature (34)..(36): n is a, c, g, or t
tgcaggaccagagaattcgaatacaaagcgagtnnnctagcgttac

SEQ ID NO: 1548 - DNA, 46 bp, Artificial Sequence
  Synthesized adaptor oligonucleotide
  misc_feature (34)..(36): n is a, c, g, or t
tgcaggaccagagaattcgaatacaagatctgcnnnctagcgttac

SEQ ID NO: 1549 - DNA, 46 bp, Artificial Sequence
  Synthesized adaptor oligonucleotide
  misc_feature (34)..(36): n is a, c, g, or t
tgcaggaccagagaattcgaatacacccgtcacnnnctagcgttac

SEQ ID NO: 1550 - DNA, 46 bp, Artificial Sequence
  Synthesized adaptor oligonucleotide
  misc_feature (34)..(36): n is a, c, g, or t
tgcaggaccagagaattcgaatacatcctcgcgnnnctagcgttac

SEQ ID NO: 1551 - DNA, 46 bp, Artificial Sequence
  Synthesized adaptor oligonucleotide
  misc_feature (34)..(36): n is a, c, g, or t
tgcaggaccagagaattcgaatacacatgtcgannnctagcgttac

SEQ ID NO: 1552 - DNA, 46 bp, Artificial Sequence
  Synthesized adaptor oligonucleotide
  misc_feature (34)..(36): n is a, c, g, or t
tgcaggaccagagaattcgaatacaaacggttcnnnctagcgttac

SEQ ID NO: 1553 - DNA, 46 bp, Artificial Sequence
  Synthesized adaptor oligonucleotide
  misc_feature (34)..(36): n is a, c, g, or t
tgcaggaccagagaattcgaatacaccccaattnnnctagcgttac

SEQ ID NO: 1554 - DNA, 46 bp, Artificial Sequence
  Synthesized adaptor oligonucleotide
  misc_feature (34)..(36): n is a, c, g, or t
tgcaggaccagagaattcgaatacaaccgttctnnnctagcgttac

SEQ ID NO: 1555 - DNA, 46 bp, Artificial Sequence
  Synthesized adaptor oligonucleotide
  misc_feature (34)..(36): n is a, c, g, or t
tgcaggaccagagaattcgaatacaactctaaannnctagcgttac

SEQ ID NO: 1556 - DNA, 46 bp, Artificial Sequence
  Synthesized adaptor oligonucleotide
  misc_feature (34)..(36): n is a, c, g, or t
tgcaggaccagagaattcgaatacaatgagctcnnnctagcgttac

SEQ ID NO: 1557 - DNA, 46 bp, Artificial Sequence
  Synthesized adaptor oligonucleotide
  misc_feature (34)..(36): n is a, c, g, or t
tgcaggaccagagaattcgaatacatctaaggcnnnctagcgttac

SEQ ID NO: 1558 - DNA, 46 bp, Artificial Sequence
  Synthesized adaptor oligonucleotide
  misc_feature (34)..(36): n is a, c, g, or t
tgcaggaccagagaattcgaatacacaatagccnnnctagcgttac

SEQ ID NO: 1559 - DNA, 46 bp, Artificial Sequence
  Synthesized adaptor oligonucleotide
  misc_feature (34)..(36): n is a, c, g, or t
tgcaggaccagagaattcgaatacatcttgcgtnnnctagcgttac

SEQ ID NO: 1560 - DNA, 46 bp, Artificial Sequence
  Synthesized adaptor oligonucleotide
  misc_feature (34)..(36): n is a, c, g, or t
tgcaggaccagagaattcgaatacacaagagcannnctagcgttac

SEQ ID NO: 1561 - DNA, 46 bp, Artificial Sequence
  Synthesized adaptor oligonucleotide
  misc_feature (34)..(36): n is a, c, g, or t
tgcaggaccagagaattcgaatacagcttggatnnnctagcgttac

SEQ ID NO: 1562 - DNA, 46 bp, Artificial Sequence
  Synthesized adaptor oligonucleotide
  misc_feature (34)..(36): n is a, c, g, or t
tgcaggaccagagaattcgaatacactaaatacnnnctagcgttac

SEQ ID NO: 1563 - DNA, 46 bp, Artificial Sequence
  Synthesized adaptor oligonucleotide
  misc_feature (34)..(36): n is a, c, g, or t
tgcaggaccagagaattcgaatacacctaaaatnnnctagcgttac

SEQ ID NO: 1564 - DNA, 46 bp, Artificial Sequence
  Synthesized adaptor oligonucleotide
  misc_feature (34)..(36): n is a, c, g, or t
tgcaggaccagagaattcgaatacagaacctcannnctagcgttac

SEQ ID NO: 1565 - DNA, 46 bp, Artificial Sequence
  Synthesized adaptor oligonucleotide
  misc_feature (34)..(36): n is a, c, g, or t
tgcaggaccagagaattcgaatacagaggcctcnnnctagcgttac

SEQ ID NO: 1566 - DNA, 46 bp, Artificial Sequence
  Synthesized adaptor oligonucleotide
  misc_feature (34)..(36): n is a, c, g, or t
tgcaggaccagagaattcgaatacaaggtgatgnnnctagcgttac

SEQ ID NO: 1567 - DNA, 46 bp, Artificial Sequence
  Synthesized adaptor oligonucleotide
  misc_feature (34)..(36): n is a, c, g, or t
tgcaggaccagagaattcgaatacaacgcgttannnctagcgttac

SEQ ID NO: 1568 - DNA, 46 bp, Artificial Sequence
  Synthesized adaptor oligonucleotide
  misc_feature (34)..(36): n is a, c, g, or t
tgcaggaccagagaattcgaatacaggtggctcnnnctagcgttac

SEQ ID NO: 1569 - DNA, 46 bp, Artificial Sequence
  Synthesized adaptor oligonucleotide
  misc_feature (34)..(36): n is a, c, g, or t
tgcaggaccagagaattcgaatacagagatcagnnngatcgacatg

SEQ ID NO: 1570 - DNA, 46 bp, Artificial Sequence
  Synthesized adaptor oligonucleotide
  misc_feature (34)..(36): n is a, c, g, or t
tgcaggaccagagaattcgaatacatacgtgtgnnngatcgacatg

SEQ ID NO: 1571 - DNA, 46 bp, Artificial Sequence
  Synthesized adaptor oligonucleotide
  misc_feature (34)..(36): n is a, c, g, or t
tgcaggaccagagaattcgaatacaagttatcannngatcgacatg

SEQ ID NO: 1572 - DNA, 46 bp, Artificial Sequence
  Synthesized adaptor oligonucleotide
  misc_feature (34)..(36): n is a, c, g, or t
tgcaggaccagagaattcgaatacacagtgatcnnngatcgacatg

SEQ ID NO: 1573 - DNA, 46 bp, Artificial Sequence
  Synthesized adaptor oligonucleotide
  misc_feature (34)..(36): n is a, c, g, or t
tgcaggaccagagaattcgaatacatacgcggcnnngatcgacatg

SEQ ID NO: 1574 - DNA, 46 bp, Artificial Sequence
  Synthesized adaptor oligonucleotide
  misc_feature (34)..(36): n is a, c, g, or t
tgcaggaccagagaattcgaatacagtgtgtacnnngatcgacatg

SEQ ID NO: 1575 - DNA, 46 bp, Artificial Sequence
  Synthesized adaptor oligonucleotide
  misc_feature (34)..(36): n is a, c, g, or t
tgcaggaccagagaattcgaatacagtgtttaannngatcgacatg

SEQ ID NO: 1576 - DNA, 46 bp, Artificial Sequence
  Synthesized adaptor oligonucleotide
  misc_feature (34)..(36): n is a, c, g, or t
tgcaggaccagagaattcgaatacagctctactnnngatcgacatg

SEQ ID NO: 1577 - DNA, 46 bp, Artificial Sequence
  Synthesized adaptor oligonucleotide
  misc_feature (34)..(36): n is a, c, g, or t
tgcaggaccagagaattcgaatacattgtgctcnnngatcgacatg

SEQ ID NO: 1578 - DNA, 46 bp, Artificial Sequence
  Synthesized adaptor oligonucleotide
  misc_feature (34)..(36): n is a, c, g, or t
tgcaggaccagagaattcgaatacatataagctnnngatcgacatg

SEQ ID NO: 1579 - DNA, 46 bp, Artificial Sequence
  Synthesized adaptor oligonucleotide
  misc_feature (34)..(36): n is a, c, g, or t
tgcaggaccagagaattcgaatacaagaacgacnnngatcgacatg

SEQ ID NO: 1580 - DNA, 46 bp, Artificial Sequence
  Synthesized adaptor oligonucleotide
  misc_feature (34)..(36): n is a, c, g, or t
tgcaggaccagagaattcgaatacatacgatatnnngatcgacatg

SEQ ID NO: 1581 - DNA, 46 bp, Artificial Sequence
  Synthesized adaptor oligonucleotide
  misc_feature (34)..(36): n is a, c, g, or t
tgcaggaccagagaattcgaatacataaacctannngatcgacatg

SEQ ID NO: 1582 - DNA, 46 bp, Artificial Sequence
  Synthesized adaptor oligonucleotide
  misc_feature (34)..(36): n is a, c, g, or t
tgcaggaccagagaattcgaatacataacgttannngatcgacatg

SEQ ID NO: 1583 - DNA, 46 bp, Artificial Sequence
  Synthesized adaptor oligonucleotide
  misc_feature (34)..(36): n is a, c, g, or t
tgcaggaccagagaattcgaatacagcacgtgcnnngatcgacatg

SEQ ID NO: 1584 - DNA, 46 bp, Artificial Sequence
  Synthesized adaptor oligonucleotide
  misc_feature (34)..(36): n is a, c, g, or t
tgcaggaccagagaattcgaatacaccctcgacnnngatcgacatg

SEQ ID NO: 1585 - DNA, 46 bp, Artificial Sequence
  Synthesized adaptor oligonucleotide
  misc_feature (34)..(36): n is a, c, g, or t
tgcaggaccagagaattcgaatacattgcatccnnngatcgacatg

SEQ ID NO: 1586 - DNA, 46 bp, Artificial Sequence
  Synthesized adaptor oligonucleotide
  misc_feature (34)..(36): n is a, c, g, or t
tgcaggaccagagaattcgaatacatcaactggnnngatcgacatg

SEQ ID NO: 1587 - DNA, 46 bp, Artificial Sequence
  Synthesized adaptor oligonucleotide
  misc_feature (34)..(36): n is a, c, g, or t
tgcaggaccagagaattcgaatacaattgccctnnngatcgacatg

SEQ ID NO: 1588 - DNA, 46 bp, Artificial Sequence
  Synthesized adaptor oligonucleotide
  misc_feature (34)..(36): n is a, c, g, or t
tgcaggaccagagaattcgaatacatacatgtannngatcgacatg

SEQ ID NO: 1589 - DNA, 46 bp, Artificial Sequence
  Synthesized adaptor oligonucleotide
  misc_feature (34)..(36): n is a, c, g, or t
tgcaggaccagagaattcgaatacagacttggtnnngatcgacatg

SEQ ID NO: 1590 - DNA, 46 bp, Artificial Sequence
  Synthesized adaptor oligonucleotide
  misc_feature (34)..(36): n is a, c, g, or t
tgcaggaccagagaattcgaatacagtcccattnnngatcgacatg

SEQ ID NO: 1591 - DNA, 46 bp, Artificial Sequence
  Synthesized adaptor oligonucleotide
  misc_feature (34)..(36): n is a, c, g, or t
tgcaggaccagagaattcgaatacaagatggtgnnngatcgacatg

SEQ ID NO: 1592 - DNA, 46 bp, Artificial Sequence
  Synthesized adaptor oligonucleotide
  misc_feature (34)..(36): n is a, c, g, or t
tgcaggaccagagaattcgaatacagacacagannngatcgacatg

SEQ ID NO: 1593 - DNA, 46 bp, Artificial Sequence
  Synthesized adaptor oligonucleotide
  misc_feature (34)..(36): n is a, c, g, or t
tgcaggaccagagaattcgaatacacgcgttttnnngatcgacatg

SEQ ID NO: 1594 - DNA, 46 bp, Artificial Sequence
  Synthesized adaptor oligonucleotide
  misc_feature (34)..(36): n is a, c, g, or t
tgcaggaccagagaattcgaatacacccagagcnnngatcgacatg

SEQ ID NO: 1595 - DNA, 46 bp, Artificial Sequence
  Synthesized adaptor oligonucleotide
  misc_feature (34)..(36): n is a, c, g, or t
tgcaggaccagagaattcgaatacacgcagctgnnngatcgacatg

SEQ ID NO: 1596 - DNA, 46 bp, Artificial Sequence
  Synthesized adaptor oligonucleotide
  misc_feature (34)..(36): n is a, c, g, or t
tgcaggaccagagaattcgaatacactttggctnnngatcgacatg

SEQ ID NO: 1597 - DNA, 46 bp, Artificial Sequence
  Synthesized adaptor oligonucleotide
  misc_feature (34)..(36): n is a, c, g, or t
tgcaggaccagagaattcgaatacagttgatcgnnngatcgacatg

SEQ ID NO: 1598 - DNA, 46 bp, Artificial Sequence
  Synthesized adaptor oligonucleotide
  misc_feature (34)..(36): n is a, c, g, or t
tgcaggaccagagaattcgaatacagtgaagtgnnngatcgacatg

SEQ ID NO: 1599 - DNA, 46 bp, Artificial Sequence
  Synthesized adaptor oligonucleotide
  misc_feature (34)..(36): n is a, c, g, or t
tgcaggaccagagaattcgaatacacacgttgannngatcgacatg

SEQ ID NO: 1600 - DNA, 46 bp, Artificial Sequence
  Synthesized adaptor oligonucleotide
  misc_feature (34)..(36): n is a, c, g, or t
tgcaggaccagagaattcgaatacacaatccagnnngatcgacatg

SEQ ID NO: 1601 - DNA, 46 bp, Artificial Sequence
  Synthesized adaptor oligonucleotide
  misc_feature (34)..(36): n is a, c, g, or t
tgcaggaccagagaattcgaatacagcgcagagnnngatcgacatg

SEQ ID NO: 1602 - DNA, 46 bp, Artificial Sequence
  Synthesized adaptor oligonucleotide
  misc_feature (34)..(36): n is a, c, g, or t
tgcaggaccagagaattcgaatacactctgatcnnngatcgacatg

SEQ ID NO: 1603 - DNA, 46 bp, Artificial Sequence
  Synthesized adaptor oligonucleotide
  misc_feature (34)..(36): n is a, c, g, or t
tgcaggaccagagaattcgaatacatatgccagnnngatcgacatg

SEQ ID NO: 1604 - DNA, 46 bp, Artificial Sequence
  Synthesized adaptor oligonucleotide
  misc_feature (34)..(36): n is a, c, g, or t
tgcaggaccagagaattcgaatacagttggtcannngatcgacatg

SEQ ID NO: 1605 - DNA, 46 bp, Artificial Sequence
  Synthesized adaptor oligonucleotide
  misc_feature (34)..(36): n is a, c, g, or t
tgcaggaccagagaattcgaatacacctctcggnnngatcgacatg

SEQ ID NO: 1606 - DNA, 46 bp, Artificial Sequence
  Synthesized adaptor oligonucleotide
  misc_feature (34)..(36): n is a, c, g, or t
tgcaggaccagagaattcgaatacatggtacacnnngatcgacatg

SEQ ID NO: 1607 - DNA, 46 bp, Artificial Sequence
  Synthesized adaptor oligonucleotide
  misc_feature (34)..(36): n is a, c, g, or t
tgcaggaccagagaattcgaatacacctcggctnnngatcgacatg

SEQ ID NO: 1608 - DNA, 46 bp, Artificial Sequence
  Synthesized adaptor oligonucleotide
  misc_feature (34)..(36): n is a, c, g, or t
tgcaggaccagagaattcgaatacagcgacggannngatcgacatg

SEQ ID NO: 1609 - DNA, 46 bp, Artificial Sequence
  Synthesized adaptor oligonucleotide
  misc_feature (34)..(36): n is a, c, g, or t
tgcaggaccagagaattcgaatacaccctgattnnngatcgacatg

SEQ ID NO: 1610 - DNA, 46 bp, Artificial Sequence
  Synthesized adaptor oligonucleotide
  misc_feature (34)..(36): n is a, c, g, or t
tgcaggaccagagaattcgaatacaattctctannngatcgacatg

SEQ ID NO: 1611 - DNA, 46 bp, Artificial Sequence
  Synthesized adaptor oligonucleotide
  misc_feature (34)..(36): n is a, c, g, or t
tgcaggaccagagaattcgaatacactgtcaagnnngatcgacatg

SEQ ID NO: 1612 - DNA, 46 bp, Artificial Sequence
  Synthesized adaptor oligonucleotide
  misc_feature (34)..(36): n is a, c, g, or t
tgcaggaccagagaattcgaatacaattaccggnnngatcgacatg

SEQ ID NO: 1613 - DNA, 46 bp, Artificial Sequence
  Synthesized adaptor oligonucleotide
  misc_feature (34)..(36): n is a, c, g, or t
tgcaggaccagagaattcgaatacataatatcgnnngatcgacatg

SEQ ID NO: 1614 - DNA, 46 bp, Artificial Sequence
  Synthesized adaptor oligonucleotide
  misc_feature (34)..(36): n is a, c, g, or t
tgcaggaccagagaattcgaatacaatagacttnnngatcgacatg

SEQ ID NO: 1615 - DNA, 46 bp, Artificial Sequence
  Synthesized adaptor oligonucleotide
  misc_feature (34)..(36): n is a, c, g, or t
tgcaggaccagagaattcgaatacacctgatagnnngatcgacatg

SEQ ID NO: 1616 - DNA, 46 bp, Artificial Sequence
  Synthesized adaptor oligonucleotide
  misc_feature (34)..(36): n is a, c, g, or t
tgcaggaccagagaattcgaatacagccgcacannngatcgacatg

SEQ ID NO: 1617 - DNA, 46 bp, Artificial Sequence
  Synthesized adaptor oligonucleotide
  misc_feature (34)..(36): n is a, c, g, or t
tgcaggaccagagaattcgaatacacgaatattnnngatcgacatg

SEQ ID NO: 1618 - DNA, 46 bp, Artificial Sequence
  Synthesized adaptor oligonucleotide
  misc_feature (34)..(36): n is a, c, g, or t
tgcaggaccagagaattcgaatacagtcaatcgnnngatcgacatg

SEQ ID NO: 1619 - DNA, 46 bp, Artificial Sequence
  Synthesized adaptor oligonucleotide
  misc_feature (34)..(36): n is a, c, g, or t
tgcaggaccagagaattcgaatacatcagccccnnngatcgacatg

SEQ ID NO: 1620 - DNA, 46 bp, Artificial Sequence
  Synthesized adaptor oligonucleotide
  misc_feature (34)..(36): n is a, c, g, or t
tgcaggaccagagaattcgaatacaggagttctnnngatcgacatg

SEQ ID NO: 1621 - DNA, 46 bp, Artificial Sequence
  Synthesized adaptor oligonucleotide
  misc_feature (34)..(36): n is a, c, g, or t
tgcaggaccagagaattcgaatacagtgaatccnnngatcgacatg

SEQ ID NO: 1622 - DNA, 46 bp, Artificial Sequence
  Synthesized adaptor oligonucleotide
  misc_feature (34)..(36): n is a, c, g, or t
tgcaggaccagagaattcgaatacaacgattatnnngatcgacatg

SEQ ID NO: 1623 - DNA, 46 bp, Artificial Sequence
  Synthesized adaptor oligonucleotide
  misc_feature (34)..(36): n is a, c, g, or t
tgcaggaccagagaattcgaatacacaatccgannngatcgacatg

SEQ ID NO: 1624 - DNA, 46 bp, Artificial Sequence
  Synthesized adaptor oligonucleotide
  misc_feature (34)..(36): n is a, c, g, or t
tgcaggaccagagaattcgaatacaggcaatgannngatcgacatg

SEQ ID NO: 1625 - DNA, 46 bp, Artificial Sequence
  Synthesized adaptor oligonucleotide
  misc_feature (34)..(36): n is a, c, g, or t
tgcaggaccagagaattcgaatacactgtcagannngatcgacatg

SEQ ID NO: 1626 - DNA, 46 bp, Artificial Sequence
  Synthesized adaptor oligonucleotide
  misc_feature (34)..(36): n is a, c, g, or t
tgcaggaccagagaattcgaatacacagacctannngatcgacatg

SEQ ID NO: 1627 - DNA, 46 bp, Artificial Sequence
  Synthesized adaptor oligonucleotide
  misc_feature (34)..(36): n is a, c, g, or t
tgcaggaccagagaattcgaatacagatcatcgnnngatcgacatg

SEQ ID NO: 1628 - DNA, 46 bp, Artificial Sequence
  Synthesized adaptor oligonucleotide
  misc_feature (34)..(36): n is a, c, g, or t
tgcaggaccagagaattcgaatacagaacgagtnnngatcgacatg

SEQ ID NO: 1629 - DNA, 46 bp, Artificial Sequence
  Synthesized adaptor oligonucleotide
  misc_feature (34)..(36): n is a, c, g, or t
tgcaggaccagagaattcgaatacatcggtgatnnntgcatcaggt

SEQ ID NO: 1630 - DNA, 46 bp, Artificial Sequence
  Synthesized adaptor oligonucleotide
  misc_feature (34)..(36): n is a, c, g, or t
tgcaggaccagagaattcgaatacaattgcaatnnntgcatcaggt

SEQ ID NO: 1631 - DNA, 46 bp, Artificial Sequence
  Synthesized adaptor oligonucleotide
  misc_feature (34)..(36): n is a, c, g, or t
tgcaggaccagagaattcgaatacattaacgatnnntgcatcaggt

SEQ ID NO: 1632 - DNA, 46 bp, Artificial Sequence
  Synthesized adaptor oligonucleotide
  misc_feature (34)..(36): n is a, c, g, or t
tgcaggaccagagaattcgaatacatgtacgtgnnntgcatcaggt

SEQ ID NO: 1633 - DNA, 46 bp, Artificial Sequence
  Synthesized adaptor oligonucleotide
  misc_feature (34)..(36): n is a, c, g, or t
tgcaggaccagagaattcgaatacagcgtgtgcnnntgcatcaggt

SEQ ID NO: 1634 - DNA, 46 bp, Artificial Sequence
  Synthesized adaptor oligonucleotide
  misc_feature (34)..(36): n is a, c, g, or t
tgcaggaccagagaattcgaatacaccatataannntgcatcaggt

SEQ ID NO: 1635 - DNA, 46 bp, Artificial Sequence
  Synthesized adaptor oligonucleotide
  misc_feature (34)..(36): n is a, c, g, or t
tgcaggaccagagaattcgaatacaaaattgagnnntgcatcaggt

SEQ ID NO: 1636 - DNA, 46 bp, Artificial Sequence
  Synthesized adaptor oligonucleotide
  misc_feature (34)..(36): n is a, c, g, or t
tgcaggaccagagaattcgaatacagtatcacgnnntgcatcaggt

SEQ ID NO: 1637 - DNA, 46 bp, Artificial Sequence
  Synthesized adaptor oligonucleotide
  misc_feature (34)..(36): n is a, c, g, or t
tgcaggaccagagaattcgaatacaccttaggannntgcatcaggt

SEQ ID NO: 1638 - DNA, 46 bp, Artificial Sequence
  Synthesized adaptor oligonucleotide
  misc_feature (34)..(36): n is a, c, g, or t
tgcaggaccagagaattcgaatacataaaaagcnnntgcatcaggt

SEQ ID NO: 1639 - DNA, 46 bp, Artificial Sequence
  Synthesized adaptor oligonucleotide
  misc_feature (34)..(36): n is a, c, g, or t
tgcaggaccagagaattcgaatacatgcatcctnnntgcatcaggt

SEQ ID NO: 1640 - DNA, 46 bp, Artificial Sequence
  Synthesized adaptor oligonucleotide
  misc_feature (34)..(36): n is a, c, g, or t
tgcaggaccagagaattcgaatacacagcctggnnntgcatcaggt

SEQ ID NO: 1641 - DNA, 46 bp, Artificial Sequence
  Synthesized adaptor oligonucleotide
  misc_feature (34)..(36): n is a, c, g, or t
tgcaggaccagagaattcgaatacacacactagnnntgcatcaggt

SEQ ID NO: 1642 - DNA, 46 bp, Artificial Sequence
  Synthesized adaptor oligonucleotide
  misc_feature (34)..(36): n is a, c, g, or t
tgcaggaccagagaattcgaatacacgtatcctnnntgcatcaggt

SEQ ID NO: 1643 - DNA, 46 bp, Artificial Sequence
  Synthesized adaptor oligonucleotide
  misc_feature (34)..(36): n is a, c, g, or t
tgcaggaccagagaattcgaatacatggcttagnnntgcatcaggt

SEQ ID NO: 1644 - DNA, 46 bp, Artificial Sequence
  Synthesized adaptor oligonucleotide
  misc_feature (34)..(36): n is a, c, g, or t
tgcaggaccagagaattcgaatacactgtcatcnnntgcatcaggt

SEQ ID NO: 1645 - DNA, 46 bp, Artificial Sequence
  Synthesized adaptor oligonucleotide
  misc_feature (34)..(36): n is a, c, g, or t
tgcaggaccagagaattcgaatacatccagaacnnntgcatcaggt

SEQ ID NO: 1646 - DNA, 46 bp, Artificial Sequence
  Synthesized adaptor oligonucleotide
  misc_feature (34)..(36): n is a, c, g, or t
tgcaggaccagagaattcgaatacacgagtactnnntgcatcaggt

SEQ ID NO: 1647 - DNA, 46 bp, Artificial Sequence
  Synthesized adaptor oligonucleotide
  misc_feature (34)..(36): n is a, c, g, or t
tgcaggaccagagaattcgaatacagatcgagannntgcatcaggt

SEQ ID NO: 1648 - DNA, 46 bp, Artificial Sequence
  Synthesized adaptor oligonucleotide
  misc_feature (34)..(36): n is a, c, g, or t
tgcaggaccagagaattcgaatacaagaataacnnntgcatcaggt

SEQ ID NO: 1649 - DNA, 46 bp, Artificial Sequence
  Synthesized adaptor oligonucleotide
  misc_feature (34)..(36): n is a, c, g, or t
tgcaggaccagagaattcgaatacagcgcaccannntgcatcaggt

SEQ ID NO: 1650 - DNA, 46 bp, Artificial Sequence
  Synthesized adaptor oligonucleotide
  misc_feature (34)..(36): n is a, c, g, or t
tgcaggaccagagaattcgaatacacagcaactnnntgcatcaggt

SEQ ID NO: 1651 - DNA, 46 bp, Artificial Sequence
  Synthesized adaptor oligonucleotide
  misc_feature (34)..(36): n is a, c, g, or t
tgcaggaccagagaattcgaatacagtgccatannntgcatcaggt

SEQ ID NO: 1652 - DNA, 46 bp, Artificial Sequence
  Synthesized adaptor oligonucleotide
  misc_feature (34)..(36): n is a, c, g, or t
tgcaggaccagagaattcgaatacaatctattcnnntgcatcaggt

SEQ ID NO: 1653 - DNA, 46 bp, Artificial Sequence
  Synthesized adaptor oligonucleotide
  misc_feature (34)..(36): n is a, c, g, or t
tgcaggaccagagaattcgaatacaagtatgttnnntgcatcaggt

SEQ ID NO: 1654 - DNA, 46 bp, Artificial Sequence
  Synthesized adaptor oligonucleotide
  misc_feature (34)..(36): n is a, c, g, or t
tgcaggaccagagaattcgaatacaggttcttcnnntgcatcaggt

SEQ ID NO: 1655 - DNA, 46 bp, Artificial Sequence
  Synthesized adaptor oligonucleotide
  misc_feature (34)..(36): n is a, c, g, or t
tgcaggaccagagaattcgaatacatagtggctnnntgcatcaggt

SEQ ID NO: 1656 - DNA, 46 bp, Artificial Sequence
  Synthesized adaptor oligonucleotide
  misc_feature (34)..(36): n is a, c, g, or t
tgcaggaccagagaattcgaatacaccaacttcnnntgcatcaggt

SEQ ID NO: 1657 - DNA, 46 bp, Artificial Sequence
  Synthesized adaptor oligonucleotide
  misc_feature (34)..(36): n is a, c, g, or t
tgcaggaccagagaattcgaatacaagttcaatnnntgcatcaggt

SEQ ID NO: 1658 - DNA, 46 bp, Artificial Sequence
  Synthesized adaptor oligonucleotide
  misc_feature (34)..(36): n is a, c, g, or t
tgcaggaccagagaattcgaatacattgttcgcnnntgcatcaggt

SEQ ID NO: 1659 - DNA, 46 bp, Artificial Sequence
  Synthesized adaptor oligonucleotide
  misc_feature (34)..(36): n is a, c, g, or t
tgcaggaccagagaattcgaatacagtcatgcannntgcatcaggt

SEQ ID NO: 1660 - DNA, 46 bp, Artificial Sequence
  Synthesized adaptor oligonucleotide
  misc_feature (34)..(36): n is a, c, g, or t
tgcaggaccagagaattcgaatacactgtaatannntgcatcaggt

SEQ ID NO: 1661 - DNA, 46 bp, Artificial Sequence
  Synthesized adaptor oligonucleotide
  misc_feature (34)..(36): n is a, c, g, or t
tgcaggaccagagaattcgaatacattcggcccnnntgcatcaggt

SEQ ID NO: 1662 - DNA, 46 bp, Artificial Sequence
  Synthesized adaptor oligonucleotide
  misc_feature (34)..(36): n is a, c, g, or t
tgcaggaccagagaattcgaatacatctctctcnnntgcatcaggt

SEQ ID NO: 1663 - DNA, 46 bp, Artificial Sequence
  Synthesized adaptor oligonucleotide
  misc_feature (34)..(36): n is a, c, g, or t
tgcaggaccagagaattcgaatacacttcgcgcnnntgcatcaggt

SEQ ID NO: 1664 - DNA, 46 bp, Artificial Sequence
  Synthesized adaptor oligonucleotide
  misc_feature (34)..(36): n is a, c, g, or t
tgcaggaccagagaattcgaatacaacagatttnnntgcatcaggt

SEQ ID NO: 1665 - DNA, 46 bp, Artificial Sequence
  Synthesized adaptor oligonucleotide
  misc_feature (34)..(36): n is a, c, g, or t
tgcaggaccagagaattcgaatacacagacaagnnntgcatcaggt

SEQ ID NO: 1666 - DNA, 46 bp, Artificial Sequence
  Synthesized adaptor oligonucleotide
  misc_feature (34)..(36): n is a, c, g, or t
tgcaggaccagagaattcgaatacacagctacannntgcatcaggt

SEQ ID NO: 1667 - DNA, 46 bp, Artificial Sequence
  Synthesized adaptor oligonucleotide
  misc_feature (34)..(36): n is a, c, g, or t
tgcaggaccagagaattcgaatacagaccgaggnnntgcatcaggt

SEQ ID NO: 1668 - DNA, 46 bp, Artificial Sequence
  Synthesized adaptor oligonucleotide
  misc_feature (34)..(36): n is a, c, g, or t
tgcaggaccagagaattcgaatacacctataaannntgcatcaggt

SEQ ID NO: 1669 - DNA, 46 bp, Artificial Sequence
  Synthesized adaptor oligonucleotide
  misc_feature (34)..(36): n is a, c, g, or t
tgcaggaccagagaattcgaatacacctaacctnnntgcatcaggt

SEQ ID NO: 1670 - DNA, 46 bp, Artificial Sequence
  Synthesized adaptor oligonucleotide
  misc_feature (34)..(36): n is a, c, g, or t
tgcaggaccagagaattcgaatacatttagcggnnntgcatcaggt

SEQ ID NO: 1671 - DNA, 46 bp, Artificial Sequence
  Synthesized adaptor oligonucleotide
  misc_feature (34)..(36): n is a, c, g, or t
tgcaggaccagagaattcgaatacataaaccatnnntgcatcaggt

SEQ ID NO: 1672 - DNA, 46 bp, Artificial Sequence
  Synthesized adaptor oligonucleotide
  misc_feature (34)..(36): n is a, c, g, or t
tgcaggaccagagaattcgaatacagctaactgnnntgcatcaggt

SEQ ID NO: 1673 - DNA, 46 bp, Artificial Sequence
  Synthesized adaptor oligonucleotide
  misc_feature (34)..(36): n is a, c, g, or t
tgcaggaccagagaattcgaatacagtacagagnnntgcatcaggt

SEQ ID NO: 1674 - DNA, 46 bp, Artificial Sequence
  Synthesized adaptor oligonucleotide
  misc_feature (34)..(36): n is a, c, g, or t
tgcaggaccagagaattcgaatacaccggaccannntgcatcaggt

SEQ ID NO: 1675 - DNA, 46 bp, Artificial Sequence
  Synthesized adaptor oligonucleotide
  misc_feature (34)..(36): n is a, c, g, or t
tgcaggaccagagaattcgaatacacctctagtnnntgcatcaggt

SEQ ID NO: 1676 - DNA, 46 bp, Artificial Sequence
  Synthesized adaptor oligonucleotide
  misc_feature (34)..(36): n is a, c, g, or t
tgcaggaccagagaattcgaatacagcccctgtnnntgcatcaggt

SEQ ID NO: 1677 - DNA, 46 bp, Artificial Sequence
  Synthesized adaptor oligonucleotide
  misc_feature (34)..(36): n is a, c, g, or t
tgcaggaccagagaattcgaatacacggactgcnnntgcatcaggt

SEQ ID NO: 1678 - DNA, 46 bp, Artificial Sequence
  Synthesized adaptor oligonucleotide
  misc_feature (34)..(36): n is a, c, g, or t
tgcaggaccagagaattcgaatacaccctctggnnntgcatcaggt

SEQ ID NO: 1679 - DNA, 46 bp, Artificial Sequence
  Synthesized adaptor oligonucleotide
  misc_feature (34)..(36): n is a, c, g, or t
tgcaggaccagagaattcgaatacaaccaagtcnnntgcatcaggt

SEQ ID NO: 1680 - DNA, 46 bp, Artificial Sequence
  Synthesized adaptor oligonucleotide
  misc_feature (34)..(36): n is a, c, g, or t
tgcaggaccagagaattcgaatacagcgtggtcnnntgcatcaggt

SEQ ID NO: 1681 - DNA, 46 bp, Artificial Sequence
  Synthesized adaptor oligonucleotide
  misc_feature (34)..(36): n is a, c, g, or t
tgcaggaccagagaattcgaatacaccgacgcannntgcatcaggt

SEQ ID NO: 1682 - DNA, 46 bp, Artificial Sequence
  Synthesized adaptor oligonucleotide
  misc_feature (34)..(36): n is a, c, g, or t
tgcaggaccagagaattcgaatacattaccggannntgcatcaggt

SEQ ID NO: 1683 - DNA, 46 bp, Artificial Sequence
  Synthesized adaptor oligonucleotide
  misc_feature (34)..(36): n is a, c, g, or t
tgcaggaccagagaattcgaatacatctttgcgnnntgcatcaggt

SEQ ID NO: 1684 - DNA, 46 bp, Artificial Sequence
  Synthesized adaptor oligonucleotide
  misc_feature (34)..(36): n is a, c, g, or t
tgcaggaccagagaattcgaatacacacaattannntgcatcaggt

SEQ ID NO: 1685 - DNA, 46 bp, Artificial Sequence
  Synthesized adaptor oligonucleotide
  misc_feature (34)..(36): n is a, c, g, or t
tgcaggaccagagaattcgaatacacctacatcnnntgcatcaggt

SEQ ID NO: 1686 - DNA, 46 bp, Artificial Sequence
  Synthesized adaptor oligonucleotide
  misc_feature (34)..(36): n is a, c, g, or t
tgcaggaccagagaattcgaatacaattactgannntgcatcaggt

SEQ ID NO: 1687 - DNA, 46 bp, Artificial Sequence
  Synthesized adaptor oligonucleotide
  misc_feature (34)..(36): n is a, c, g, or t
tgcaggaccagagaattcgaatacatttttcgannntgcatcaggt

SEQ ID NO: 1688 - DNA, 46 bp, Artificial Sequence
  Synthesized adaptor oligonucleotide
  misc_feature (34)..(36): n is a, c, g, or t
tgcaggaccagagaattcgaatacaaggtgcttnnntgcatcaggt

SEQ ID NO: 1689 - DNA, 46 bp, Artificial Sequence
  Synthesized adaptor olignonucleotide
  misc_feature (34)..(36): n is a, c, g, or t
tgcaggaccagagaattcgaatacaactaccagnnnacgtatgcca

SEQ ID NO: 1690 - DNA, 46 bp, Artificial Sequence
  Synthesized adaptor olignonucleotide
  misc_feature (34)..(36): n is a, c, g, or t
tgcaggaccagagaattcgaatacattattgagnnnacgtatgcca

SEQ ID NO: 1691 - DNA, 46 bp, Artificial Sequence
  Synthesized adaptor olignonucleotide
  misc_feature (34)..(36): n is a, c, g, or t
tgcaggaccagagaattcgaatacaactgtgtgnnnacgtatgcca

SEQ ID NO: 1692 - DNA, 46 bp, Artificial Sequence
  Synthesized adaptor olignonucleotide
  misc_feature (34)..(36): n is a, c, g, or t
tgcaggaccagagaattcgaatacattgatcggnnnacgtatgcca

SEQ ID NO: 1693 - DNA, 46 bp, Artificial Sequence
  Synthesized adaptor olignonucleotide
  misc_feature (34)..(36): n is a, c, g, or t
tgcaggaccagagaattcgaatacattctcggtnnnacgtatgcca

SEQ ID NO: 1694 - DNA, 46 bp, Artificial Sequence
  Synthesized adaptor olignonucleotide
  misc_feature (34)..(36): n is a, c, g, or t
tgcaggaccagagaattcgaatacaccagttagnnnacgtatgcca

SEQ ID NO: 1695 - DNA, 46 bp, Artificial Sequence
  Synthesized adaptor olignonucleotide
  misc_feature (34)..(36): n is a, c, g, or t
tgcaggaccagagaattcgaatacaagaacaatnnnacgtatgcca

SEQ ID NO: 1696 - DNA, 46 bp, Artificial Sequence
  Synthesized adaptor olignonucleotide
  misc_feature (34)..(36): n is a, c, g, or t
tgcaggaccagagaattcgaatacatccgaagtnnnacgtatgcca

SEQ ID NO: 1697 - DNA, 46 bp, Artificial Sequence
  Synthesized adaptor olignonucleotide
  misc_feature (34)..(36): n is a, c, g, or t
tgcaggaccagagaattcgaatacatcggctccnnnacgtatgcca

SEQ ID NO: 1698 - DNA, 46 bp, Artificial Sequence
  Synthesized adaptor olignonucleotide
  misc_feature (34)..(36): n is a, c, g, or t
tgcaggaccagagaattcgaatacacagtccccnnnacgtatgcca

SEQ ID NO: 1699 - DNA, 46 bp, Artificial Sequence
  Synthesized adaptor olignonucleotide
  misc_feature (34)..(36): n is a, c, g, or t
tgcaggaccagagaattcgaatacagtcaactgnnnacgtatgcca

SEQ ID NO: 1700 - DNA, 46 bp, Artificial Sequence
  Synthesized adaptor olignonucleotide
  misc_feature (34)..(36): n is a, c, g, or t
tgcaggaccagagaattcgaatacaggcggcttnnnacgtatgcca

SEQ ID NO: 1701 - DNA, 46 bp, Artificial Sequence
  Synthesized adaptor olignonucleotide
  misc_feature (34)..(36): n is a, c, g, or t
tgcaggaccagagaattcgaatacaatgcgctannnacgtatgcca

SEQ ID NO: 1702 - DNA, 46 bp, Artificial Sequence
  Synthesized adaptor olignonucleotide
  misc_feature (34)..(36): n is a, c, g, or t
tgcaggaccagagaattcgaatacagctccggannnacgtatgcca

SEQ ID NO: 1703 - DNA, 46 bp, Artificial Sequence
  Synthesized adaptor olignonucleotide
  misc_feature (34)..(36): n is a, c, g, or t
tgcaggaccagagaattcgaatacatgctggcgnnnacgtatgcca

SEQ ID NO: 1704 - DNA, 46 bp, Artificial Sequence
  Synthesized adaptor olignonucleotide
  misc_feature (34)..(36): n is a, c, g, or t
tgcaggaccagagaattcgaatacactaacgtgnnnacgtatgcca

SEQ ID NO: 1705 - DNA, 46 bp, Artificial Sequence
  Synthesized adaptor olignonucleotide
  misc_feature (34)..(36): n is a, c, g, or t
tgcaggaccagagaattcgaatacagaatacaannnacgtatgcca

SEQ ID NO: 1706 - DNA, 46 bp, Artificial Sequence
  Synthesized adaptor olignonucleotide
  misc_feature (34)..(36): n is a, c, g, or t
tgcaggaccagagaattcgaatacaatgacaaannnacgtatgcca

SEQ ID NO: 1707 - DNA, 46 bp, Artificial Sequence
  Synthesized adaptor olignonucleotide
  misc_feature (34)..(36): n is a, c, g, or t
tgcaggaccagagaattcgaatacaacggctcgnnnacgtatgcca

SEQ ID NO: 1708 - DNA, 46 bp, Artificial Sequence
  Synthesized adaptor olignonucleotide
  misc_feature (34)..(36): n is a, c, g, or t
tgcaggaccagagaattcgaatacaacagataannnacgtatgcca

SEQ ID NO: 1709 - DNA, 46 bp, Artificial Sequence
  Synthesized adaptor olignonucleotide
  misc_feature (34)..(36): n is a, c, g, or t
tgcaggaccagagaattcgaatacatgtagccannnacgtatgcca

SEQ ID NO: 1710 - DNA, 46 bp, Artificial Sequence
  Synthesized adaptor olignonucleotide
  misc_feature (34)..(36): n is a, c, g, or t
tgcaggaccagagaattcgaatacacttctgcannnacgtatgcca

SEQ ID NO: 1711 - DNA, 46 bp, Artificial Sequence
  Synthesized adaptor olignonucleotide
  misc_feature (34)..(36): n is a, c, g, or t
tgcaggaccagagaattcgaatacattaccttannnacgtatgcca

SEQ ID NO: 1712 - DNA, 46 bp, Artificial Sequence
  Synthesized adaptor olignonucleotide
  misc_feature (34)..(36): n is a, c, g, or t
tgcaggaccagagaattcgaatacatcaattctnnnacgtatgcca

SEQ ID NO: 1713 - DNA, 46 bp, Artificial Sequence
  Synthesized adaptor olignonucleotide
  misc_feature (34)..(36): n is a, c, g, or t
tgcaggaccagagaattcgaatacaaggttcgtnnnacgtatgcca

SEQ ID NO: 1714 - DNA, 46 bp, Artificial Sequence
  Synthesized adaptor olignonucleotide
  misc_feature (34)..(36): n is a, c, g, or t
tgcaggaccagagaattcgaatacaattttaaannnacgtatgcca

SEQ ID NO: 1715 - DNA, 46 bp, Artificial Sequence
  Synthesized adaptor olignonucleotide
  misc_feature (34)..(36): n is a, c, g, or t
tgcaggaccagagaattcgaatacattgcagacnnnacgtatgcca

SEQ ID NO: 1716 - DNA, 46 bp, Artificial Sequence
  Synthesized adaptor olignonucleotide
  misc_feature (34)..(36): n is a, c, g, or t
tgcaggaccagagaattcgaatacaccccactgnnnacgtatgcca

SEQ ID NO: 1717 - DNA, 46 bp, Artificial Sequence
  Synthesized adaptor olignonucleotide
  misc_feature (34)..(36): n is a, c, g, or t
tgcaggaccagagaattcgaatacacttcctgannnacgtatgcca

SEQ ID NO: 1718 - DNA, 46 bp, Artificial Sequence
  Synthesized adaptor olignonucleotide
  misc_feature (34)..(36): n is a, c, g, or t
tgcaggaccagagaattcgaatacaagaactccnnnacgtatgcca

SEQ ID NO: 1719 - DNA, 46 bp, Artificial Sequence
  Synthesized adaptor olignonucleotide
  misc_feature (34)..(36): n is a, c, g, or t
tgcaggaccagagaattcgaatacactgtaagcnnnacgtatgcca

SEQ ID NO: 1720 - DNA, 46 bp, Artificial Sequence
  Synthesized adaptor olignonucleotide
  misc_feature (34)..(36): n is a, c, g, or t
tgcaggaccagagaattcgaatacaagtcgatcnnnacgtatgcca

SEQ ID NO: 1721 - DNA, 46 bp, Artificial Sequence
  Synthesized adaptor olignonucleotide
  misc_feature (34)..(36): n is a, c, g, or t
tgcaggaccagagaattcgaatacagtaatagannnacgtatgcca

SEQ ID NO: 1722 - DNA, 46 bp, Artificial Sequence
  Synthesized adaptor olignonucleotide
  misc_feature (34)..(36): n is a, c, g, or t
tgcaggaccagagaattcgaatacacggagctcnnnacgtatgcca

SEQ ID NO: 1723 - DNA, 46 bp, Artificial Sequence
  Synthesized adaptor olignonucleotide
  misc_feature (34)..(36): n is a, c, g, or t
tgcaggaccagagaattcgaatacattgtcttannnacgtatgcca

SEQ ID NO: 1724 - DNA, 46 bp, Artificial Sequence
  Synthesized adaptor olignonucleotide
  misc_feature (34)..(36): n is a, c, g, or t
tgcaggaccagagaattcgaatacattttcgtannnacgtatgcca

SEQ ID NO: 1725 - DNA, 46 bp, Artificial Sequence
  Synthesized adaptor olignonucleotide
  misc_feature (34)..(36): n is a, c, g, or t
tgcaggaccagagaattcgaatacaaacggaacnnnacgtatgcca

SEQ ID NO: 1726 - DNA, 46 bp, Artificial Sequence
  Synthesized adaptor olignonucleotide
  misc_feature (34)..(36): n is a, c, g, or t
tgcaggaccagagaattcgaatacaaccacggcnnnacgtatgcca

SEQ ID NO: 1727 - DNA, 46 bp, Artificial Sequence
  Synthesized adaptor olignonucleotide
  misc_feature (34)..(36): n is a, c, g, or t
tgcaggaccagagaattcgaatacagagtatttnnnacgtatgcca

SEQ ID NO: 1728 - DNA, 46 bp, Artificial Sequence
  Synthesized adaptor olignonucleotide
  misc_feature (34)..(36): n is a, c, g, or t
tgcaggaccagagaattcgaatacacccgcctannnacgtatgcca

SEQ ID NO: 1729 - DNA, 46 bp, Artificial Sequence
  Synthesized adaptor olignonucleotide
  misc_feature (34)..(36): n is a, c, g, or t
tgcaggaccagagaattcgaatacaagtatgccnnnacgtatgcca

SEQ ID NO: 1730 - DNA, 46 bp, Artificial Sequence
  Synthesized adaptor olignonucleotide
  misc_feature (34)..(36): n is a, c, g, or t
tgcaggaccagagaattcgaatacatagcagctnnnacgtatgcca

SEQ ID NO: 1731 - DNA, 46 bp, Artificial Sequence
  Synthesized adaptor olignonucleotide
  misc_feature (34)..(36): n is a, c, g, or t
tgcaggaccagagaattcgaatacacgcgtgacnnnacgtatgcca

SEQ ID NO: 1732 - DNA, 46 bp, Artificial Sequence
  Synthesized adaptor olignonucleotide
  misc_feature (34)..(36): n is a, c, g, or t
tgcaggaccagagaattcgaatacaaaatacgannnacgtatgcca

SEQ ID NO: 1733 - DNA, 46 bp, Artificial Sequence
  Synthesized adaptor olignonucleotide
  misc_feature (34)..(36): n is a, c, g, or t
tgcaggaccagagaattcgaatacactagatatnnnacgtatgcca

SEQ ID NO: 1734 - DNA, 46 bp, Artificial Sequence
  Synthesized adaptor olignonucleotide
  misc_feature (34)..(36): n is a, c, g, or t
tgcaggaccagagaattcgaatacaatgttggcnnnacgtatgcca

SEQ ID NO: 1735 - DNA, 46 bp, Artificial Sequence
  Synthesized adaptor olignonucleotide
  misc_feature (34)..(36): n is a, c, g, or t
tgcaggaccagagaattcgaatacactacgcaannnacgtatgcca

SEQ ID NO: 1736 - DNA, 46 bp, Artificial Sequence
  Synthesized adaptor olignonucleotide
  misc_feature (34)..(36): n is a, c, g, or t
tgcaggaccagagaattcgaatacatttctgtannnacgtatgcca

SEQ ID NO: 1737 - DNA, 46 bp, Artificial Sequence
  Synthesized adaptor olignonucleotide
  misc_feature (34)..(36): n is a, c, g, or t
tgcaggaccagagaattcgaatacacctccctcnnnacgtatgcca

SEQ ID NO: 1738 - DNA, 46 bp, Artificial Sequence
  Synthesized adaptor olignonucleotide
  misc_feature (34)..(36): n is a, c, g, or t
tgcaggaccagagaattcgaatacagacttgacnnnacgtatgcca

SEQ ID NO: 1739 - DNA, 46 bp, Artificial Sequence
  Synthesized adaptor olignonucleotide
  misc_feature (34)..(36): n is a, c, g, or t
tgcaggaccagagaattcgaatacagtcatcgannnacgtatgcca

SEQ ID NO: 1740 - DNA, 46 bp, Artificial Sequence
  Synthesized adaptor olignonucleotide
  misc_feature (34)..(36): n is a, c, g, or t
tgcaggaccagagaattcgaatacaatctagtannnacgtatgcca

SEQ ID NO: 1741 - DNA, 46 bp, Artificial Sequence
  Synthesized adaptor olignonucleotide
  misc_feature (34)..(36): n is a, c, g, or t
tgcaggaccagagaattcgaatacacgaagatgnnnacgtatgcca

SEQ ID NO: 1742 - DNA, 46 bp, Artificial Sequence
  Synthesized adaptor olignonucleotide
  misc_feature (34)..(36): n is a, c, g, or t
tgcaggaccagagaattcgaatacaatttgcaannnacgtatgcca

SEQ ID NO: 1743 - DNA, 46 bp, Artificial Sequence
  Synthesized adaptor olignonucleotide
  misc_feature (34)..(36): n is a, c, g, or t
tgcaggaccagagaattcgaatacagaccggctnnnacgtatgcca

SEQ ID NO: 1744 - DNA, 46 bp, Artificial Sequence
  Synthesized adaptor olignonucleotide
  misc_feature (34)..(36): n is a, c, g, or t
tgcaggaccagagaattcgaatacacttgtcacnnnacgtatgcca

SEQ ID NO: 1745 - DNA, 46 bp, Artificial Sequence
  Synthesized adaptor olignonucleotide
  misc_feature (34)..(36): n is a, c, g, or t
tgcaggaccagagaattcgaatacactcgtaagnnnacgtatgcca

SEQ ID NO: 1746 - DNA, 46 bp, Artificial Sequence
  Synthesized adaptor olignonucleotide
  misc_feature (34)..(36): n is a, c, g, or t
tgcaggaccagagaattcgaatacagccttactnnnacgtatgcca

SEQ ID NO: 1747 - DNA, 46 bp, Artificial Sequence
  Synthesized adaptor olignonucleotide
  misc_feature (34)..(36): n is a, c, g, or t
tgcaggaccagagaattcgaatacagcatgtgtnnnacgtatgcca

SEQ ID NO: 1748 - DNA, 46 bp, Artificial Sequence
  Synthesized adaptor olignonucleotide
  misc_feature (34)..(36): n is a, c, g, or t
tgcaggaccagagaattcgaatacactactgtcnnnacgtatgcca

SEQ ID NO: 1749 - DNA, 46 bp, Artificial Sequence
  Synthesized adaptor olignonucleotide
  misc_feature (34)..(36): n is a, c, g, or t
tgcaggaccagagaattcgaatacaatctaacannnctagcgttac

SEQ ID NO: 1750 - DNA, 46 bp, Artificial Sequence
  Synthesized adaptor olignonucleotide
  misc_feature (34)..(36): n is a, c, g, or t
tgcaggaccagagaattcgaatacaacgattcgnnnctagcgttac

SEQ ID NO: 1751 - DNA, 46 bp, Artificial Sequence
  Synthesized adaptor olignonucleotide
  misc_feature (34)..(36): n is a, c, g, or t
tgcaggaccagagaattcgaatacaaaaccttannnctagcgttac

SEQ ID NO: 1752 - DNA, 46 bp, Artificial Sequence
  Synthesized adaptor olignonucleotide
  misc_feature (34)..(36): n is a, c, g, or t
tgcaggaccagagaattcgaatacacgtaaaaannnctagcgttac

SEQ ID NO: 1753 - DNA, 46 bp, Artificial Sequence
  Synthesized adaptor olignonucleotide
  misc_feature (34)..(36): n is a, c, g, or t
tgcaggaccagagaattcgaatacatctgagacnnnctagcgttac

SEQ ID NO: 1754 - DNA, 46 bp, Artificial Sequence
  Synthesized adaptor olignonucleotide
  misc_feature (34)..(36): n is a, c, g, or t
tgcaggaccagagaattcgaatacatggcgattnnnctagcgttac

SEQ ID NO: 1755 - DNA, 46 bp, Artificial Sequence
  Synthesized adaptor olignonucleotide
  misc_feature (34)..(36): n is a, c, g, or t
tgcaggaccagagaattcgaatacacatcttgcnnnctagcgttac

SEQ ID NO: 1756 - DNA, 46 bp, Artificial Sequence
  Synthesized adaptor olignonucleotide
  misc_feature (34)..(36): n is a, c, g, or t
tgcaggaccagagaattcgaatacatctttcggnnnctagcgttac

SEQ ID NO: 1757 - DNA, 46 bp, Artificial Sequence
  Synthesized adaptor olignonucleotide
  misc_feature (34)..(36): n is a, c, g, or t
tgcaggaccagagaattcgaatacagcgaacaannnctagcgttac

SEQ ID NO: 1758 - DNA, 46 bp, Artificial Sequence
  Synthesized adaptor olignonucleotide
  misc_feature (34)..(36): n is a, c, g, or t
tgcaggaccagagaattcgaatacagagtagacnnnctagcgttac

SEQ ID NO: 1759 - DNA, 46 bp, Artificial Sequence
  Synthesized adaptor olignonucleotide
  misc_feature (34)..(36): n is a, c, g, or t
tgcaggaccagagaattcgaatacactcatggannnctagcgttac

SEQ ID NO: 1760 - DNA, 46 bp, Artificial Sequence
  Synthesized adaptor olignonucleotide
  misc_feature (34)..(36): n is a, c, g, or t
tgcaggaccagagaattcgaatacattcccggcnnnctagcgttac

SEQ ID NO: 1761 - DNA, 46 bp, Artificial Sequence
  Synthesized adaptor olignonucleotide
  misc_feature (34)..(36): n is a, c, g, or t
tgcaggaccagagaattcgaatacatggcctaannnctagcgttac

SEQ ID NO: 1762 - DNA, 46 bp, Artificial Sequence
  Synthesized adaptor olignonucleotide
  misc_feature (34)..(36): n is a, c, g, or t
tgcaggaccagagaattcgaatacaagcgcaaannnctagcgttac

SEQ ID NO: 1763 - DNA, 46 bp, Artificial Sequence
  Synthesized adaptor olignonucleotide
  misc_feature (34)..(36): n is a, c, g, or t
tgcaggaccagagaattcgaatacaatagaaacnnnctagcgttac

SEQ ID NO: 1764 - DNA, 46 bp, Artificial Sequence
  Synthesized adaptor olignonucleotide
  misc_feature (34)..(36): n is a, c, g, or t
tgcaggaccagagaattcgaatacatcggctggnnnctagcgttac

SEQ ID NO: 1765 - DNA, 46 bp, Artificial Sequence
  Synthesized adaptor olignonucleotide
  misc_feature (34)..(36): n is a, c, g, or t
tgcaggaccagagaattcgaatacagtgctcggnnnctagcgttac

SEQ ID NO: 1766 - DNA, 46 bp, Artificial Sequence
  Synthesized adaptor olignonucleotide
  misc_feature (34)..(36): n is a, c, g, or t
tgcaggaccagagaattcgaatacaaatgccacnnnctagcgttac

SEQ ID NO: 1767 - DNA, 46 bp, Artificial Sequence
  Synthesized adaptor olignonucleotide
  misc_feature (34)..(36): n is a, c, g, or t
tgcaggaccagagaattcgaatacaatcacgtgnnnctagcgttac

SEQ ID NO: 1768 - DNA, 46 bp, Artificial Sequence
  Synthesized adaptor olignonucleotide
  misc_feature (34)..(36): n is a, c, g, or t
tgcaggaccagagaattcgaatacatcacgacannnctagcgttac

SEQ ID NO: 1769 - DNA, 46 bp, Artificial Sequence
  Synthesized adaptor olignonucleotide
  misc_feature (34)..(36): n is a, c, g, or t
tgcaggaccagagaattcgaatacatgttacggnnnctagcgttac

SEQ ID NO: 1770 - DNA, 46 bp, Artificial Sequence
  Synthesized adaptor olignonucleotide
  misc_feature (34)..(36): n is a, c, g, or t
tgcaggaccagagaattcgaatacattaccgctnnnctagcgttac

SEQ ID NO: 1771 - DNA, 46 bp, Artificial Sequence
  Synthesized adaptor olignonucleotide
  misc_feature (34)..(36): n is a, c, g, or t
tgcaggaccagagaattcgaatacaccctttagnnnctagcgttac

SEQ ID NO: 1772 - DNA, 46 bp, Artificial Sequence
  Synthesized adaptor olignonucleotide
  misc_feature (34)..(36): n is a, c, g, or t
tgcaggaccagagaattcgaatacagtcttgagnnnctagcgttac

SEQ ID NO: 1773 - DNA, 46 bp, Artificial Sequence
  Synthesized adaptor olignonucleotide
  misc_feature (34)..(36): n is a, c, g, or t
tgcaggaccagagaattcgaatacactttgaccnnnctagcgttac

SEQ ID NO: 1774 - DNA, 46 bp, Artificial Sequence
  Synthesized adaptor olignonucleotide
  misc_feature (34)..(36): n is a, c, g, or t
tgcaggaccagagaattcgaatacacttctcagnnnctagcgttac

SEQ ID NO: 1775 - DNA, 46 bp, Artificial Sequence
  Synthesized adaptor olignonucleotide
  misc_feature (34)..(36): n is a, c, g, or t
tgcaggaccagagaattcgaatacatgttgcagnnnctagcgttac

SEQ ID NO: 1776 - DNA, 46 bp, Artificial Sequence
  Synthesized adaptor olignonucleotide
  misc_feature (34)..(36): n is a, c, g, or t
tgcaggaccagagaattcgaatacaaacccaacnnnctagcgttac

SEQ ID NO: 1777 - DNA, 46 bp, Artificial Sequence
  Synthesized adaptor olignonucleotide
  misc_feature (34)..(36): n is a, c, g, or t
tgcaggaccagagaattcgaatacataagcaccnnnctagcgttac

SEQ ID NO: 1778 - DNA, 46 bp, Artificial Sequence
  Synthesized adaptor olignonucleotide
  misc_feature (34)..(36): n is a, c, g, or t
tgcaggaccagagaattcgaatacagatgtaaannnctagcgttac

SEQ ID NO: 1779 - DNA, 46 bp, Artificial Sequence
  Synthesized adaptor olignonucleotide
  misc_feature (34)..(36): n is a, c, g, or t
tgcaggaccagagaattcgaatacagttatgcgnnnctagcgttac

SEQ ID NO: 1780 - DNA, 46 bp, Artificial Sequence
  Synthesized adaptor olignonucleotide
  misc_feature (34)..(36): n is a, c, g, or t
tgcaggaccagagaattcgaatacagcgcggaannnctagcgttac

SEQ ID NO: 1781 - DNA, 46 bp, Artificial Sequence
  Synthesized adaptor olignonucleotide
  misc_feature (34)..(36): n is a, c, g, or t
tgcaggaccagagaattcgaatacaagatttgtnnnctagcgttac

SEQ ID NO: 1782 - DNA, 46 bp, Artificial Sequence
  Synthesized adaptor olignonucleotide
  misc_feature (34)..(36): n is a, c, g, or t
tgcaggaccagagaattcgaatacacacagctannnctagcgttac

SEQ ID NO: 1783 - DNA, 46 bp, Artificial Sequence
  Synthesized adaptor olignonucleotide
  misc_feature (34)..(36): n is a, c, g, or t
tgcaggaccagagaattcgaatacaacggcaggnnnctagcgttac

SEQ ID NO: 1784 - DNA, 46 bp, Artificial Sequence
  Synthesized adaptor olignonucleotide
  misc_feature (34)..(36): n is a, c, g, or t
tgcaggaccagagaattcgaatacatacggaagnnnctagcgttac

SEQ ID NO: 1785 - DNA, 46 bp, Artificial Sequence
  Synthesized adaptor olignonucleotide
  misc_feature (34)..(36): n is a, c, g, or t
tgcaggaccagagaattcgaatacactcgatgannnctagcgttac

SEQ ID NO: 1786 - DNA, 46 bp, Artificial Sequence
  Synthesized adaptor olignonucleotide
  misc_feature (34)..(36): n is a, c, g, or t
tgcaggaccagagaattcgaatacatcccccctnnnctagcgttac

SEQ ID NO: 1787 - DNA, 46 bp, Artificial Sequence
  Synthesized adaptor olignonucleotide
  misc_feature (34)..(36): n is a, c, g, or t
tgcaggaccagagaattcgaatacaccatctacnnnctagcgttac

SEQ ID NO: 1788 - DNA, 46 bp, Artificial Sequence
  Synthesized adaptor olignonucleotide
  misc_feature (34)..(36): n is a, c, g, or t
tgcaggaccagagaattcgaatacaaagcaggtnnnctagcgttac

SEQ ID NO: 1789 - DNA, 46 bp, Artificial Sequence
  Synthesized adaptor olignonucleotide
  misc_feature (34)..(36): n is a, c, g, or t
tgcaggaccagagaattcgaatacaaagtcaaannnctagcgttac

SEQ ID NO: 1790 - DNA, 46 bp, Artificial Sequence
  Synthesized adaptor olignonucleotide
  misc_feature (34)..(36): n is a, c, g, or t
tgcaggaccagagaattcgaatacaattcgacgnnnctagcgttac

SEQ ID NO: 1791 - DNA, 46 bp, Artificial Sequence
  Synthesized adaptor olignonucleotide
  misc_feature (34)..(36): n is a, c, g, or t
tgcaggaccagagaattcgaatacaaccagccgnnnctagcgttac

SEQ ID NO: 1792 - DNA, 46 bp, Artificial Sequence
  Synthesized adaptor olignonucleotide
  misc_feature (34)..(36): n is a, c, g, or t
tgcaggaccagagaattcgaatacatagtcggtnnnctagcgttac

SEQ ID NO: 1793 - DNA, 46 bp, Artificial Sequence
  Synthesized adaptor olignonucleotide
  misc_feature (34)..(36): n is a, c, g, or t
tgcaggaccagagaattcgaatacatgcgcatannnctagcgttac

SEQ ID NO: 1794 - DNA, 46 bp, Artificial Sequence
  Synthesized adaptor olignonucleotide
  misc_feature (34)..(36): n is a, c, g, or t
tgcaggaccagagaattcgaatacatagaacccnnnctagcgttac

SEQ ID NO: 1795 - DNA, 46 bp, Artificial Sequence
  Synthesized adaptor olignonucleotide
  misc_feature (34)..(36): n is a, c, g, or t
tgcaggaccagagaattcgaatacaggtttgtgnnnctagcgttac

SEQ ID NO: 1796 - DNA, 46 bp, Artificial Sequence
  Synthesized adaptor olignonucleotide
  misc_feature (34)..(36): n is a, c, g, or t
tgcaggaccagagaattcgaatacaaagtttgtnnnctagcgttac

SEQ ID NO: 1797 - DNA, 46 bp, Artificial Sequence
  Synthesized adaptor olignonucleotide
  misc_feature (34)..(36): n is a, c, g, or t
tgcaggaccagagaattcgaatacattagcgacnnnctagcgttac

SEQ ID NO: 1798 - DNA, 46 bp, Artificial Sequence
  Synthesized adaptor olignonucleotide
  misc_feature (34)..(36): n is a, c, g, or t
tgcaggaccagagaattcgaatacagatatatcnnnctagcgttac

SEQ ID NO: 1799 - DNA, 46 bp, Artificial Sequence
  Synthesized adaptor olignonucleotide
  misc_feature (34)..(36): n is a, c, g, or t
tgcaggaccagagaattcgaatacaaactgtgcnnnctagcgttac

SEQ ID NO: 1800 - DNA, 46 bp, Artificial Sequence
  Synthesized adaptor olignonucleotide
  misc_feature (34)..(36): n is a, c, g, or t
tgcaggaccagagaattcgaatacacgaatggannnctagcgttac

SEQ ID NO: 1801 - DNA, 46 bp, Artificial Sequence
  Synthesized adaptor olignonucleotide
  misc_feature (34)..(36): n is a, c, g, or t
tgcaggaccagagaattcgaatacacttcgttgnnnctagcgttac

SEQ ID NO: 1802 - DNA, 46 bp, Artificial Sequence
  Synthesized adaptor olignonucleotide
  misc_feature (34)..(36): n is a, c, g, or t
tgcaggaccagagaattcgaatacatcgtggtannnctagcgttac

SEQ ID NO: 1803 - DNA, 46 bp, Artificial Sequence
  Synthesized adaptor olignonucleotide
  misc_feature (34)..(36): n is a, c, g, or t
tgcaggaccagagaattcgaatacagcaaaatannnctagcgttac

SEQ ID NO: 1804 - DNA, 46 bp, Artificial Sequence
  Synthesized adaptor olignonucleotide
  misc_feature (34)..(36): n is a, c, g, or t
tgcaggaccagagaattcgaatacaagactaaannnctagcgttac

SEQ ID NO: 1805 - DNA, 46 bp, Artificial Sequence
  Synthesized adaptor olignonucleotide
  misc_feature (34)..(36): n is a, c, g, or t
tgcaggaccagagaattcgaatacatgcgagttnnnctagcgttac

SEQ ID NO: 1806 - DNA, 46 bp, Artificial Sequence
  Synthesized adaptor olignonucleotide
  misc_feature (34)..(36): n is a, c, g, or t
tgcaggaccagagaattcgaatacagttctgagnnnctagcgttac

SEQ ID NO: 1807 - DNA, 46 bp, Artificial Sequence
  Synthesized adaptor olignonucleotide
  misc_feature (34)..(36): n is a, c, g, or t
tgcaggaccagagaattcgaatacatcggcgtgnnnctagcgttac

SEQ ID NO: 1808 - DNA, 46 bp, Artificial Sequence
  Synthesized adaptor olignonucleotide
  misc_feature (34)..(36): n is a, c, g, or t
tgcaggaccagagaattcgaatacagatccggcnnnctagcgttac

SEQ ID NO: 1809 - DNA, 46 bp, Artificial Sequence
  Synthesized adaptor olignonucleotide
  misc_feature (34)..(36): n is a, c, g, or t
tgcaggaccagagaattcgaatacagtgtatgcnnngatcgacatg

SEQ ID NO: 1810 - DNA, 46 bp, Artificial Sequence
  Synthesized adaptor olignonucleotide
  misc_feature (34)..(36): n is a, c, g, or t
tgcaggaccagagaattcgaatacaagtatttgnnngatcgacatg

SEQ ID NO: 1811 - DNA, 46 bp, Artificial Sequence
  Synthesized adaptor olignonucleotide
  misc_feature (34)..(36): n is a, c, g, or t
tgcaggaccagagaattcgaatacaagtaaaacnnngatcgacatg

SEQ ID NO: 1812 - DNA, 46 bp, Artificial Sequence
  Synthesized adaptor olignonucleotide
  misc_feature (34)..(36): n is a, c, g, or t
tgcaggaccagagaattcgaatacaagccaccgnnngatcgacatg

SEQ ID NO: 1813 - DNA, 46 bp, Artificial Sequence
  Synthesized adaptor olignonucleotide
  misc_feature (34)..(36): n is a, c, g, or t
tgcaggaccagagaattcgaatacaaagtgtccnnngatcgacatg

SEQ ID NO: 1814 - DNA, 46 bp, Artificial Sequence
  Synthesized adaptor olignonucleotide
  misc_feature (34)..(36): n is a, c, g, or t
tgcaggaccagagaattcgaatacactatttgtnnngatcgacatg

SEQ ID NO: 1815 - DNA, 46 bp, Artificial Sequence
  Synthesized adaptor olignonucleotide
  misc_feature (34)..(36): n is a, c, g, or t
tgcaggaccagagaattcgaatacagtgtatcgnnngatcgacatg

SEQ ID NO: 1816 - DNA, 46 bp, Artificial Sequence
  Synthesized adaptor olignonucleotide
  misc_feature (34)..(36): n is a, c, g, or t
tgcaggaccagagaattcgaatacaatagtatcnnngatcgacatg

SEQ ID NO: 1817 - DNA, 46 bp, Artificial Sequence
  Synthesized adaptor olignonucleotide
  misc_feature (34)..(36): n is a, c, g, or t
tgcaggaccagagaattcgaatacaccgctgagnnngatcgacatg

SEQ ID NO: 1818 - DNA, 46 bp, Artificial Sequence
  Synthesized adaptor olignonucleotide
  misc_feature (34)..(36): n is a, c, g, or t
tgcaggaccagagaattcgaatacattattttannngatcgacatg

SEQ ID NO: 1819 - DNA, 46 bp, Artificial Sequence
  Synthesized adaptor olignonucleotide
  misc_feature (34)..(36): n is a, c, g, or t
tgcaggaccagagaattcgaatacaacaagacgnnngatcgacatg

SEQ ID NO: 1820 - DNA, 46 bp, Artificial Sequence
  Synthesized adaptor olignonucleotide
  misc_feature (34)..(36): n is a, c, g, or t
tgcaggaccagagaattcgaatacataagtatcnnngatcgacatg

SEQ ID NO: 1821 - DNA, 46 bp, Artificial Sequence
  Synthesized adaptor olignonucleotide
  misc_feature (34)..(36): n is a, c, g, or t
tgcaggaccagagaattcgaatacaggcacaccnnngatcgacatg

SEQ ID NO: 1822 - DNA, 46 bp, Artificial Sequence
  Synthesized adaptor olignonucleotide
  misc_feature (34)..(36): n is a, c, g, or t
tgcaggaccagagaattcgaatacagtacctctnnngatcgacatg

SEQ ID NO: 1823 - DNA, 46 bp, Artificial Sequence
  Synthesized adaptor olignonucleotide
  misc_feature (34)..(36): n is a, c, g, or t
tgcaggaccagagaattcgaatacactgtgatgnnngatcgacatg

SEQ ID NO: 1824 - DNA, 46 bp, Artificial Sequence
  Synthesized adaptor olignonucleotide
  misc_feature (34)..(36): n is a, c, g, or t
tgcaggaccagagaattcgaatacaacaaggacnnngatcgacatg

SEQ ID NO: 1825 - DNA, 46 bp, Artificial Sequence
  Synthesized adaptor olignonucleotide
  misc_feature (34)..(36): n is a, c, g, or t
tgcaggaccagagaattcgaatacaagaggctannngatcgacatg

SEQ ID NO: 1826 - DNA, 46 bp, Artificial Sequence
  Synthesized adaptor olignonucleotide
  misc_feature (34)..(36): n is a, c, g, or t
tgcaggaccagagaattcgaatacaattgagttnnngatcgacatg

SEQ ID NO: 1827 - DNA, 46 bp, Artificial Sequence
  Synthesized adaptor olignonucleotide
  misc_feature (34)..(36): n is a, c, g, or t
tgcaggaccagagaattcgaatacacgttctcannngatcgacatg

SEQ ID NO: 1828 - DNA, 46 bp, Artificial Sequence
  Synthesized adaptor olignonucleotide
  misc_feature (34)..(36): n is a, c, g, or t
tgcaggaccagagaattcgaatacaggtagcttnnngatcgacatg

SEQ ID NO: 1829 - DNA, 46 bp, Artificial Sequence
  Synthesized adaptor olignonucleotide
  misc_feature (34)..(36): n is a, c, g, or t
tgcaggaccagagaattcgaatacatccttgtgnnngatcgacatg

SEQ ID NO: 1830 - DNA, 46 bp, Artificial Sequence
  Synthesized adaptor olignonucleotide
  misc_feature (34)..(36): n is a, c, g, or t
tgcaggaccagagaattcgaatacagccgacacnnngatcgacatg

SEQ ID NO: 1831 - DNA, 46 bp, Artificial Sequence
  Synthesized adaptor olignonucleotide
  misc_feature (34)..(36): n is a, c, g, or t
tgcaggaccagagaattcgaatacaactagaggnnngatcgacatg

SEQ ID NO: 1832 - DNA, 46 bp, Artificial Sequence
  Synthesized adaptor olignonucleotide
  misc_feature (34)..(36): n is a, c, g, or t
tgcaggaccagagaattcgaatacaacagtcgtnnngatcgacatg

SEQ ID NO: 1833 - DNA, 46 bp, Artificial Sequence
  Synthesized adaptor olignonucleotide
  misc_feature (34)..(36): n is a, c, g, or t
tgcaggaccagagaattcgaatacacgaggcgannngatcgacatg

SEQ ID NO: 1834 - DNA, 46 bp, Artificial Sequence
  Synthesized adaptor olignonucleotide
  misc_feature (34)..(36): n is a, c, g, or t
tgcaggaccagagaattcgaatacaaccgaaagnnngatcgacatg

SEQ ID NO: 1835 - DNA, 46 bp, Artificial Sequence
  Synthesized adaptor olignonucleotide
  misc_feature (34)..(36): n is a, c, g, or t
tgcaggaccagagaattcgaatacagtttgagcnnngatcgacatg

SEQ ID NO: 1836 - DNA, 46 bp, Artificial Sequence
  Synthesized adaptor olignonucleotide
  misc_feature (34)..(36): n is a, c, g, or t
tgcaggaccagagaattcgaatacagtatgcgtnnngatcgacatg

SEQ ID NO: 1837 - DNA, 46 bp, Artificial Sequence
  Synthesized adaptor olignonucleotide
  misc_feature (34)..(36): n is a, c, g, or t
tgcaggaccagagaattcgaatacaatgtaactnnngatcgacatg

SEQ ID NO: 1838 - DNA, 46 bp, Artificial Sequence
  Synthesized adaptor olignonucleotide
  misc_feature (34)..(36): n is a, c, g, or t
tgcaggaccagagaattcgaatacaagacgtagnnngatcgacatg

SEQ ID NO: 1839 - DNA, 46 bp, Artificial Sequence
  Synthesized adaptor olignonucleotide
  misc_feature (34)..(36): n is a, c, g, or t
tgcaggaccagagaattcgaatacattggcgcgnnngatcgacatg

SEQ ID NO: 1840 - DNA, 46 bp, Artificial Sequence
  Synthesized adaptor olignonucleotide
  misc_feature (34)..(36): n is a, c, g, or t
tgcaggaccagagaattcgaatacaggactcatnnngatcgacatg

SEQ ID NO: 1841 - DNA, 46 bp, Artificial Sequence
  Synthesized adaptor olignonucleotide
  misc_feature (34)..(36): n is a, c, g, or t
tgcaggaccagagaattcgaatacagtccggtgnnngatcgacatg

SEQ ID NO: 1842 - DNA, 46 bp, Artificial Sequence
  Synthesized adaptor olignonucleotide
  misc_feature (34)..(36): n is a, c, g, or t
tgcaggaccagagaattcgaatacagcaagcccnnngatcgacatg

SEQ ID NO: 1843 - DNA, 46 bp, Artificial Sequence
  Synthesized adaptor olignonucleotide
  misc_feature (34)..(36): n is a, c, g, or t
tgcaggaccagagaattcgaatacaagcatggannngatcgacatg

SEQ ID NO: 1844 - DNA, 46 bp, Artificial Sequence
  Synthesized adaptor olignonucleotide
  misc_feature (34)..(36): n is a, c, g, or t
tgcaggaccagagaattcgaatacaagcagcccnnngatcgacatg

SEQ ID NO: 1845 - DNA, 46 bp, Artificial Sequence
  Synthesized adaptor olignonucleotide
  misc_feature (34)..(36): n is a, c, g, or t
tgcaggaccagagaattcgaatacaatctctatnnngatcgacatg

SEQ ID NO: 1846 - DNA, 46 bp, Artificial Sequence
  Synthesized adaptor olignonucleotide
  misc_feature (34)..(36): n is a, c, g, or t
tgcaggaccagagaattcgaatacataatgccgnnngatcgacatg

SEQ ID NO: 1847 - DNA, 46 bp, Artificial Sequence
  Synthesized adaptor olignonucleotide
  misc_feature (34)..(36): n is a, c, g, or t
tgcaggaccagagaattcgaatacacaggcggannngatcgacatg

SEQ ID NO: 1848 - DNA, 46 bp, Artificial Sequence
  Synthesized adaptor olignonucleotide
  misc_feature (34)..(36): n is a, c, g, or t
tgcaggaccagagaattcgaatacagcgaatgannngatcgacatg

SEQ ID NO: 1849 - DNA, 46 bp, Artificial Sequence
  Synthesized adaptor olignonucleotide
  misc_feature (34)..(36): n is a, c, g, or t
tgcaggaccagagaattcgaatacaagcgtactnnngatcgacatg

SEQ ID NO: 1850 - DNA, 46 bp, Artificial Sequence
  Synthesized adaptor olignonucleotide
  misc_feature (34)..(36): n is a, c, g, or t
tgcaggaccagagaattcgaatacacccaggcannngatcgacatg

SEQ ID NO: 1851 - DNA, 46 bp, Artificial Sequence
  Synthesized adaptor olignonucleotide
  misc_feature (34)..(36): n is a, c, g, or t
tgcaggaccagagaattcgaatacaggcctgtgnnngatcgacatg

SEQ ID NO: 1852 - DNA, 46 bp, Artificial Sequence
  Synthesized adaptor olignonucleotide
  misc_feature (34)..(36): n is a, c, g, or t
tgcaggaccagagaattcgaatacacctaggcgnnngatcgacatg

SEQ ID NO: 1853 - DNA, 46 bp, Artificial Sequence
  Synthesized adaptor olignonucleotide
  misc_feature (34)..(36): n is a, c, g, or t
tgcaggaccagagaattcgaatacaccgttttgnnngatcgacatg

SEQ ID NO: 1854 - DNA, 46 bp, Artificial Sequence
  Synthesized adaptor olignonucleotide
  misc_feature (34)..(36): n is a, c, g, or t
tgcaggaccagagaattcgaatacagacgcaccnnngatcgacatg

SEQ ID NO: 1855 - DNA, 46 bp, Artificial Sequence
  Synthesized adaptor olignonucleotide
  misc_feature (34)..(36): n is a, c, g, or t
tgcaggaccagagaattcgaatacaacttatgannngatcgacatg

SEQ ID NO: 1856 - DNA, 46 bp, Artificial Sequence
  Synthesized adaptor olignonucleotide
  misc_feature (34)..(36): n is a, c, g, or t
tgcaggaccagagaattcgaatacaagatcaaannngatcgacatg

SEQ ID NO: 1857 - DNA, 46 bp, Artificial Sequence
  Synthesized adaptor olignonucleotide
  misc_feature (34)..(36): n is a, c, g, or t
tgcaggaccagagaattcgaatacatacttccgnnngatcgacatg

SEQ ID NO: 1858 - DNA, 46 bp, Artificial Sequence
  Synthesized adaptor olignonucleotide
  misc_feature (34)..(36): n is a, c, g, or t
tgcaggaccagagaattcgaatacacgttagacnnngatcgacatg

SEQ ID NO: 1859 - DNA, 46 bp, Artificial Sequence
  Synthesized adaptor olignonucleotide
  misc_feature (34)..(36): n is a, c, g, or t
tgcaggaccagagaattcgaatacaggagttagnnngatcgacatg

SEQ ID NO: 1860 - DNA, 46 bp, Artificial Sequence
  Synthesized adaptor olignonucleotide
  misc_feature (34)..(36): n is a, c, g, or t
tgcaggaccagagaattcgaatacagacctcttnnngatcgacatg

SEQ ID NO: 1861 - DNA, 46 bp, Artificial Sequence
  Synthesized adaptor olignonucleotide
  misc_feature (34)..(36): n is a, c, g, or t
tgcaggaccagagaattcgaatacagcccgcaannngatcgacatg

SEQ ID NO: 1862 - DNA, 46 bp, Artificial Sequence
  Synthesized adaptor olignonucleotide
  misc_feature (34)..(36): n is a, c, g, or t
tgcaggaccagagaattcgaatacagaacccatnnngatcgacatg

SEQ ID NO: 1863 - DNA, 46 bp, Artificial Sequence
  Synthesized adaptor olignonucleotide
  misc_feature (34)..(36): n is a, c, g, or t
tgcaggaccagagaattcgaatacaccactgccnnngatcgacatg

SEQ ID NO: 1864 - DNA, 46 bp, Artificial Sequence
  Synthesized adaptor olignonucleotide
  misc_feature (34)..(36): n is a, c, g, or t
tgcaggaccagagaattcgaatacactaatttcnnngatcgacatg

SEQ ID NO: 1865 - DNA, 46 bp, Artificial Sequence
  Synthesized adaptor olignonucleotide
  misc_feature (34)..(36): n is a, c, g, or t
tgcaggaccagagaattcgaatacacggtccagnnngatcgacatg

SEQ ID NO: 1866 - DNA, 46 bp, Artificial Sequence
  Synthesized adaptor olignonucleotide
  misc_feature (34)..(36): n is a, c, g, or t
tgcaggaccagagaattcgaatacatttcgcacnnngatcgacatg

SEQ ID NO: 1867 - DNA, 46 bp, Artificial Sequence
  Synthesized adaptor olignonucleotide
  misc_feature (34)..(36): n is a, c, g, or t
tgcaggaccagagaattcgaatacaggataagcnnngatcgacatg

SEQ ID NO: 1868 - DNA, 46 bp, Artificial Sequence
  Synthesized adaptor olignonucleotide
  misc_feature (34)..(36): n is a, c, g, or t
tgcaggaccagagaattcgaatacactcgcaggnnngatcgacatg

SEQ ID NO: 1869 - DNA, 46 bp, Artificial Sequence
  Synthesized adaptor olignonucleotide
  misc_feature (34)..(36): n is a, c, g, or t
tgcaggaccagagaattcgaatacaactgaaaannntgcatcaggt

SEQ ID NO: 1870 - DNA, 46 bp, Artificial Sequence
  Synthesized adaptor olignonucleotide
  misc_feature (34)..(36): n is a, c, g, or t
tgcaggaccagagaattcgaatacaagtcttttnnntgcatcaggt

SEQ ID NO: 1871 - DNA, 46 bp, Artificial Sequence
  Synthesized adaptor olignonucleotide
  misc_feature (34)..(36): n is a, c, g, or t
tgcaggaccagagaattcgaatacaggtgttacnnntgcatcaggt

SEQ ID NO: 1872 - DNA, 46 bp, Artificial Sequence
  Synthesized adaptor olignonucleotide
  misc_feature (34)..(36): n is a, c, g, or t
tgcaggaccagagaattcgaatacatatccgctnnntgcatcaggt

SEQ ID NO: 1873 - DNA, 46 bp, Artificial Sequence
  Synthesized adaptor olignonucleotide
  misc_feature (34)..(36): n is a, c, g, or t
tgcaggaccagagaattcgaatacagcgtgaggnnntgcatcaggt

SEQ ID NO: 1874 - DNA, 46 bp, Artificial Sequence
  Synthesized adaptor olignonucleotide
  misc_feature (34)..(36): n is a, c, g, or t
tgcaggaccagagaattcgaatacagccgttccnnntgcatcaggt

SEQ ID NO: 1875 - DNA, 46 bp, Artificial Sequence
  Synthesized adaptor olignonucleotide
  misc_feature (34)..(36): n is a, c, g, or t
tgcaggaccagagaattcgaatacattaccccannntgcatcaggt

SEQ ID NO: 1876 - DNA, 46 bp, Artificial Sequence
  Synthesized adaptor olignonucleotide
  misc_feature (34)..(36): n is a, c, g, or t
tgcaggaccagagaattcgaatacagacccctcnnntgcatcaggt

SEQ ID NO: 1877 - DNA, 46 bp, Artificial Sequence
  Synthesized adaptor olignonucleotide
  misc_feature (34)..(36): n is a, c, g, or t
tgcaggaccagagaattcgaatacatatggaggnnntgcatcaggt

SEQ ID NO: 1878 - DNA, 46 bp, Artificial Sequence
  Synthesized adaptor olignonucleotide
  misc_feature (34)..(36): n is a, c, g, or t
tgcaggaccagagaattcgaatacagacggtccnnntgcatcaggt

SEQ ID NO: 1879 - DNA, 46 bp, Artificial Sequence
  Synthesized adaptor olignonucleotide
  misc_feature (34)..(36): n is a, c, g, or t
tgcaggaccagagaattcgaatacactacgacannntgcatcaggt

SEQ ID NO: 1880 - DNA, 46 bp, Artificial Sequence
  Synthesized adaptor olignonucleotide
  misc_feature (34)..(36): n is a, c, g, or t
tgcaggaccagagaattcgaatacatgactacgnnntgcatcaggt

SEQ ID NO: 1881 - DNA, 46 bp, Artificial Sequence
  Synthesized adaptor olignonucleotide
  misc_feature (34)..(36): n is a, c, g, or t
tgcaggaccagagaattcgaatacaggacgtttnnntgcatcaggt

SEQ ID NO: 1882 - DNA, 46 bp, Artificial Sequence
  Synthesized adaptor olignonucleotide
  misc_feature (34)..(36): n is a, c, g, or t
tgcaggaccagagaattcgaatacaaagcctcannntgcatcaggt

SEQ ID NO: 1883 - DNA, 46 bp, Artificial Sequence
  Synthesized adaptor olignonucleotide
  misc_feature (34)..(36): n is a, c, g, or t
tgcaggaccagagaattcgaatacactttaaagnnntgcatcaggt

SEQ ID NO: 1884 - DNA, 46 bp, Artificial Sequence
  Synthesized adaptor olignonucleotide
  misc_feature (34)..(36): n is a, c, g, or t
tgcaggaccagagaattcgaatacatttgattcnnntgcatcaggt

SEQ ID NO: 1885 - DNA, 46 bp, Artificial Sequence
  Synthesized adaptor olignonucleotide
  misc_feature (34)..(36): n is a, c, g, or t
tgcaggaccagagaattcgaatacactgtatttnnntgcatcaggt

SEQ ID NO: 1886 - DNA, 46 bp, Artificial Sequence
  Synthesized adaptor olignonucleotide
  misc_feature (34)..(36): n is a, c, g, or t
tgcaggaccagagaattcgaatacattaattggnnntgcatcaggt

SEQ ID NO: 1887 - DNA, 46 bp, Artificial Sequence
  Synthesized adaptor olignonucleotide
  misc_feature (34)..(36): n is a, c, g, or t
tgcaggaccagagaattcgaatacacagagttcnnntgcatcaggt

SEQ ID NO: 1888 - DNA, 46 bp, Artificial Sequence
  Synthesized adaptor olignonucleotide
  misc_feature (34)..(36): n is a, c, g, or t
tgcaggaccagagaattcgaatacagcatctagnnntgcatcaggt

SEQ ID NO: 1889 - DNA, 46 bp, Artificial Sequence
  Synthesized adaptor olignonucleotide
  misc_feature (34)..(36): n is a, c, g, or t
tgcaggaccagagaattcgaatacattgtctatnnntgcatcaggt

SEQ ID NO: 1890 - DNA, 46 bp, Artificial Sequence
  Synthesized adaptor olignonucleotide
  misc_feature (34)..(36): n is a, c, g, or t
tgcaggaccagagaattcgaatacacatcctgtnnntgcatcaggt

SEQ ID NO: 1891 - DNA, 46 bp, Artificial Sequence
  Synthesized adaptor olignonucleotide
  misc_feature (34)..(36): n is a, c, g, or t
tgcaggaccagagaattcgaatacacattcaaannntgcatcaggt

SEQ ID NO: 1892 - DNA, 46 bp, Artificial Sequence
  Synthesized adaptor olignonucleotide
  misc_feature (34)..(36): n is a, c, g, or t
tgcaggaccagagaattcgaatacaaaagcctcnnntgcatcaggt

SEQ ID NO: 1893 - DNA, 46 bp, Artificial Sequence
  Synthesized adaptor olignonucleotide
  misc_feature (34)..(36): n is a, c, g, or t
tgcaggaccagagaattcgaatacatgatcaatnnntgcatcaggt

SEQ ID NO: 1894 - DNA, 46 bp, Artificial Sequence
  Synthesized adaptor olignonucleotide
  misc_feature (34)..(36): n is a, c, g, or t
tgcaggaccagagaattcgaatacaatatgatcnnntgcatcaggt

SEQ ID NO: 1895 - DNA, 46 bp, Artificial Sequence
  Synthesized adaptor olignonucleotide
  misc_feature (34)..(36): n is a, c, g, or t
tgcaggaccagagaattcgaatacaggaccgagnnntgcatcaggt

SEQ ID NO: 1896 - DNA, 46 bp, Artificial Sequence
  Synthesized adaptor olignonucleotide
  misc_feature (34)..(36): n is a, c, g, or t
tgcaggaccagagaattcgaatacacccctaatnnntgcatcaggt

SEQ ID NO: 1897 - DNA, 46 bp, Artificial Sequence
  Synthesized adaptor olignonucleotide
  misc_feature (34)..(36): n is a, c, g, or t
tgcaggaccagagaattcgaatacactcaaagcnnntgcatcaggt

SEQ ID NO: 1898 - DNA, 46 bp, Artificial Sequence
  Synthesized adaptor olignonucleotide
  misc_feature (34)..(36): n is a, c, g, or t
tgcaggaccagagaattcgaatacacttcgtacnnntgcatcaggt

SEQ ID NO: 1899 - DNA, 46 bp, Artificial Sequence
  Synthesized adaptor olignonucleotide
  misc_feature (34)..(36): n is a, c, g, or t
tgcaggaccagagaattcgaatacaattggccannntgcatcaggt

SEQ ID NO: 1900 - DNA, 46 bp, Artificial Sequence
  Synthesized adaptor olignonucleotide
  misc_feature (34)..(36): n is a, c, g, or t
tgcaggaccagagaattcgaatacacgaaggtannntgcatcaggt

SEQ ID NO: 1901 - DNA, 46 bp, Artificial Sequence
  Synthesized adaptor olignonucleotide
  misc_feature (34)..(36): n is a, c, g, or t
tgcaggaccagagaattcgaatacaggccttggnnntgcatcaggt

SEQ ID NO: 1902 - DNA, 46 bp, Artificial Sequence
  Synthesized adaptor olignonucleotide
  misc_feature (34)..(36): n is a, c, g, or t
tgcaggaccagagaattcgaatacaacaatatcnnntgcatcaggt

SEQ ID NO: 1903 - DNA, 46 bp, Artificial Sequence
  Synthesized adaptor olignonucleotide
  misc_feature (34)..(36): n is a, c, g, or t
tgcaggaccagagaattcgaatacatcacaacgnnntgcatcaggt

SEQ ID NO: 1904 - DNA, 46 bp, Artificial Sequence
  Synthesized adaptor olignonucleotide
  misc_feature (34)..(36): n is a, c, g, or t
tgcaggaccagagaattcgaatacaactgtacgnnntgcatcaggt

SEQ ID NO: 1905 - DNA, 46 bp, Artificial Sequence
  Synthesized adaptor olignonucleotide
  misc_feature (34)..(36): n is a, c, g, or t
tgcaggaccagagaattcgaatacatctcaattnnntgcatcaggt

SEQ ID NO: 1906 - DNA, 46 bp, Artificial Sequence
  Synthesized adaptor olignonucleotide
  misc_feature (34)..(36): n is a, c, g, or t
tgcaggaccagagaattcgaatacaaggctctannntgcatcaggt

SEQ ID NO: 1907 - DNA, 46 bp, Artificial Sequence
  Synthesized adaptor olignonucleotide
  misc_feature (34)..(36): n is a, c, g, or t
tgcaggaccagagaattcgaatacaccttaccannntgcatcaggt

SEQ ID NO: 1908 - DNA, 46 bp, Artificial Sequence
  Synthesized adaptor olignonucleotide
  misc_feature (34)..(36): n is a, c, g, or t
tgcaggaccagagaattcgaatacagattcctcnnntgcatcaggt

SEQ ID NO: 1909 - DNA, 46 bp, Artificial Sequence
  Synthesized adaptor olignonucleotide
  misc_feature (34)..(36): n is a, c, g, or t
tgcaggaccagagaattcgaatacatgcctgttnnntgcatcaggt

SEQ ID NO: 1910 - DNA, 46 bp, Artificial Sequence
  Synthesized adaptor olignonucleotide
  misc_feature (34)..(36): n is a, c, g, or t
tgcaggaccagagaattcgaatacatcaccaagnnntgcatcaggt

SEQ ID NO: 1911 - DNA, 46 bp, Artificial Sequence
  Synthesized adaptor olignonucleotide
  misc_feature (34)..(36): n is a, c, g, or t
tgcaggaccagagaattcgaatacacttccggcnnntgcatcaggt

SEQ ID NO: 1912 - DNA, 46 bp, Artificial Sequence
  Synthesized adaptor olignonucleotide
  misc_feature (34)..(36): n is a, c, g, or t
tgcaggaccagagaattcgaatacaaaacgcagnnntgcatcaggt

SEQ ID NO: 1913 - DNA, 46 bp, Artificial Sequence
  Synthesized adaptor olignonucleotide
  misc_feature (34)..(36): n is a, c, g, or t
tgcaggaccagagaattcgaatacacgcattctnnntgcatcaggt

SEQ ID NO: 1914 - DNA, 46 bp, Artificial Sequence
  Synthesized adaptor olignonucleotide
  misc_feature (34)..(36): n is a, c, g, or t
tgcaggaccagagaattcgaatacacgcctattnnntgcatcaggt

SEQ ID NO: 1915 - DNA, 46 bp, Artificial Sequence
  Synthesized adaptor olignonucleotide
  misc_feature (34)..(36): n is a, c, g, or t
tgcaggaccagagaattcgaatacatcatcattnnntgcatcaggt

SEQ ID NO: 1916 - DNA, 46 bp, Artificial Sequence
  Synthesized adaptor olignonucleotide
  misc_feature (34)..(36): n is a, c, g, or t
tgcaggaccagagaattcgaatacaaattcagtnnntgcatcaggt

SEQ ID NO: 1917 - DNA, 46 bp, Artificial Sequence
  Synthesized adaptor olignonucleotide
  misc_feature (34)..(36): n is a, c, g, or t
tgcaggaccagagaattcgaatacaattctcgcnnntgcatcaggt

SEQ ID NO: 1918 - DNA, 46 bp, Artificial Sequence
  Synthesized adaptor olignonucleotide
  misc_feature (34)..(36): n is a, c, g, or t
tgcaggaccagagaattcgaatacaatagagtannntgcatcaggt

SEQ ID NO: 1919 - DNA, 46 bp, Artificial Sequence
  Synthesized adaptor olignonucleotide
  misc_feature (34)..(36): n is a, c, g, or t
tgcaggaccagagaattcgaatacagagcggacnnntgcatcaggt

SEQ ID NO: 1920 - DNA, 46 bp, Artificial Sequence
  Synthesized adaptor olignonucleotide
  misc_feature (34)..(36): n is a, c, g, or t
tgcaggaccagagaattcgaatacaacttttacnnntgcatcaggt

SEQ ID NO: 1921 - DNA, 46 bp, Artificial Sequence
  Synthesized adaptor olignonucleotide
  misc_feature (34)..(36): n is a, c, g, or t
tgcaggaccagagaattcgaatacaagtcaaaannntgcatcaggt

SEQ ID NO: 1922 - DNA, 46 bp, Artificial Sequence
  Synthesized adaptor olignonucleotide
  misc_feature (34)..(36): n is a, c, g, or t
tgcaggaccagagaattcgaatacatctagacgnnntgcatcaggt

SEQ ID NO: 1923 - DNA, 46 bp, Artificial Sequence
  Synthesized adaptor olignonucleotide
  misc_feature (34)..(36): n is a, c, g, or t
tgcaggaccagagaattcgaatacacaaatgttnnntgcatcaggt

SEQ ID NO: 1924 - DNA, 46 bp, Artificial Sequence
  Synthesized adaptor olignonucleotide
  misc_feature (34)..(36): n is a, c, g, or t
tgcaggaccagagaattcgaatacatggctttcnnntgcatcaggt

SEQ ID NO: 1925 - DNA, 46 bp, Artificial Sequence
  Synthesized adaptor olignonucleotide
  misc_feature (34)..(36): n is a, c, g, or t
tgcaggaccagagaattcgaatacaaggctgttnnntgcatcaggt

SEQ ID NO: 1926 - DNA, 46 bp, Artificial Sequence
  Synthesized adaptor olignonucleotide
  misc_feature (34)..(36): n is a, c, g, or t
tgcaggaccagagaattcgaatacaaactattgnnntgcatcaggt

SEQ ID NO: 1927 - DNA, 46 bp, Artificial Sequence
  Synthesized adaptor olignonucleotide
  misc_feature (34)..(36): n is a, c, g, or t
tgcaggaccagagaattcgaatacaatgtattgnnntgcatcaggt

SEQ ID NO: 1928 - DNA, 46 bp, Artificial Sequence
  Synthesized adaptor olignonucleotide
  misc_feature (34)..(36): n is a, c, g, or t
tgcaggaccagagaattcgaatacacgtcggcannntgcatcaggt

SEQ ID NO: 1929 - DNA, 46 bp, Artificial Sequence
  Synthesized adaptor olignonucleotide
  misc_feature (34)..(36): n is a, c, g, or t
tgcaggaccagagaattcgaatacagaacgcccnnnacgtatgcca

SEQ ID NO: 1930 - DNA, 46 bp, Artificial Sequence
  Synthesized adaptor olignonucleotide
  misc_feature (34)..(36): n is a, c, g, or t
tgcaggaccagagaattcgaatacaaccaatgcnnnacgtatgcca

SEQ ID NO: 1931 - DNA, 46 bp, Artificial Sequence
  Synthesized adaptor olignonucleotide
  misc_feature (34)..(36): n is a, c, g, or t
tgcaggaccagagaattcgaatacagaccgattnnnacgtatgcca

SEQ ID NO: 1932 - DNA, 46 bp, Artificial Sequence
  Synthesized adaptor olignonucleotide
  misc_feature (34)..(36): n is a, c, g, or t
tgcaggaccagagaattcgaatacaatgttatgnnnacgtatgcca

SEQ ID NO: 1933 - DNA, 46 bp, Artificial Sequence
  Synthesized adaptor olignonucleotide
  misc_feature (34)..(36): n is a, c, g, or t
tgcaggaccagagaattcgaatacaggaagaagnnnacgtatgcca

SEQ ID NO: 1934 - DNA, 46 bp, Artificial Sequence
  Synthesized adaptor olignonucleotide
  misc_feature (34)..(36): n is a, c, g, or t
tgcaggaccagagaattcgaatacagttatacannnacgtatgcca

SEQ ID NO: 1935 - DNA, 46 bp, Artificial Sequence
  Synthesized adaptor olignonucleotide
  misc_feature (34)..(36): n is a, c, g, or t
tgcaggaccagagaattcgaatacacctcctaannnacgtatgcca

SEQ ID NO: 1936 - DNA, 46 bp, Artificial Sequence
  Synthesized adaptor olignonucleotide
  misc_feature (34)..(36): n is a, c, g, or t
tgcaggaccagagaattcgaatacataaacatcnnnacgtatgcca

SEQ ID NO: 1937 - DNA, 46 bp, Artificial Sequence
  Synthesized adaptor olignonucleotide
  misc_feature (34)..(36): n is a, c, g, or t
tgcaggaccagagaattcgaatacacggcggttnnnacgtatgcca

SEQ ID NO: 1938 - DNA, 46 bp, Artificial Sequence
  Synthesized adaptor olignonucleotide
  misc_feature (34)..(36): n is a, c, g, or t
tgcaggaccagagaattcgaatacattaacaacnnnacgtatgcca

SEQ ID NO: 1939 - DNA, 46 bp, Artificial Sequence
  Synthesized adaptor olignonucleotide
  misc_feature (34)..(36): n is a, c, g, or t
tgcaggaccagagaattcgaatacatggccatannnacgtatgcca

SEQ ID NO: 1940 - DNA, 46 bp, Artificial Sequence
  Synthesized adaptor olignonucleotide
  misc_feature (34)..(36): n is a, c, g, or t
tgcaggaccagagaattcgaatacagagtgatgnnnacgtatgcca

SEQ ID NO: 1941 - DNA, 46 bp, Artificial Sequence
  Synthesized adaptor olignonucleotide
  misc_feature (34)..(36): n is a, c, g, or t
tgcaggaccagagaattcgaatacactaatgcgnnnacgtatgcca

SEQ ID NO: 1942 - DNA, 46 bp, Artificial Sequence
  Synthesized adaptor olignonucleotide
  misc_feature (34)..(36): n is a, c, g, or t
tgcaggaccagagaattcgaatacaaggttaaannnacgtatgcca

SEQ ID NO: 1943 - DNA, 46 bp, Artificial Sequence
  Synthesized adaptor olignonucleotide
  misc_feature (34)..(36): n is a, c, g, or t
tgcaggaccagagaattcgaatacaacagtaccnnnacgtatgcca

SEQ ID NO: 1944 - DNA, 46 bp, Artificial Sequence
  Synthesized adaptor olignonucleotide
  misc_feature (34)..(36): n is a, c, g, or t
tgcaggaccagagaattcgaatacaatgtgattnnnacgtatgcca

SEQ ID NO: 1945 - DNA, 46 bp, Artificial Sequence
  Synthesized adaptor olignonucleotide
  misc_feature (34)..(36): n is a, c, g, or t
tgcaggaccagagaattcgaatacagctgccgannnacgtatgcca

SEQ ID NO: 1946 - DNA, 46 bp, Artificial Sequence
  Synthesized adaptor olignonucleotide
  misc_feature (34)..(36): n is a, c, g, or t
tgcaggaccagagaattcgaatacactttttagnnnacgtatgcca

SEQ ID NO: 1947 - DNA, 46 bp, Artificial Sequence
  Synthesized adaptor olignonucleotide
  misc_feature (34)..(36): n is a, c, g, or t
tgcaggaccagagaattcgaatacatcccaaagnnnacgtatgcca

SEQ ID NO: 1948 - DNA, 46 bp, Artificial Sequence
  Synthesized adaptor olignonucleotide
  misc_feature (34)..(36): n is a, c, g, or t
tgcaggaccagagaattcgaatacagacactacnnnacgtatgcca

SEQ ID NO: 1949 - DNA, 46 bp, Artificial Sequence
  Synthesized adaptor olignonucleotide
  misc_feature (34)..(36): n is a, c, g, or t
tgcaggaccagagaattcgaatacaataccgacnnnacgtatgcca

SEQ ID NO: 1950 - DNA, 46 bp, Artificial Sequence
  Synthesized adaptor olignonucleotide
  misc_feature (34)..(36): n is a, c, g, or t
tgcaggaccagagaattcgaatacagttgaaaannnacgtatgcca

SEQ ID NO: 1951 - DNA, 46 bp, Artificial Sequence
  Synthesized adaptor olignonucleotide
  misc_feature (34)..(36): n is a, c, g, or t
tgcaggaccagagaattcgaatacaatttcctannnacgtatgcca

SEQ ID NO: 1952 - DNA, 46 bp, Artificial Sequence
  Synthesized adaptor olignonucleotide
  misc_feature (34)..(36): n is a, c, g, or t
tgcaggaccagagaattcgaatacaacgttcagnnnacgtatgcca

SEQ ID NO: 1953 - DNA, 46 bp, Artificial Sequence
  Synthesized adaptor olignonucleotide
  misc_feature (34)..(36): n is a, c, g, or t
tgcaggaccagagaattcgaatacaaatacgaannnacgtatgcca

SEQ ID NO: 1954 - DNA, 46 bp, Artificial Sequence
  Synthesized adaptor olignonucleotide
  misc_feature (34)..(36): n is a, c, g, or t
tgcaggaccagagaattcgaatacaccaactgannnacgtatgcca

SEQ ID NO: 1955 - DNA, 46 bp, Artificial Sequence
  Synthesized adaptor olignonucleotide
  misc_feature (34)..(36): n is a, c, g, or t
tgcaggaccagagaattcgaatacaatccgtctnnnacgtatgcca

SEQ ID NO: 1956 - DNA, 46 bp, Artificial Sequence
  Synthesized adaptor olignonucleotide
  misc_feature (34)..(36): n is a, c, g, or t
tgcaggaccagagaattcgaatacacgtccgctnnnacgtatgcca

SEQ ID NO: 1957 - DNA, 46 bp, Artificial Sequence
  Synthesized adaptor olignonucleotide
  misc_feature (34)..(36): n is a, c, g, or t
tgcaggaccagagaattcgaatacatatacacannnacgtatgcca

SEQ ID NO: 1958 - DNA, 46 bp, Artificial Sequence
  Synthesized adaptor olignonucleotide
  misc_feature (34)..(36): n is a, c, g, or t
tgcaggaccagagaattcgaatacactctatatnnnacgtatgcca

SEQ ID NO: 1959 - DNA, 46 bp, Artificial Sequence
  Synthesized adaptor olignonucleotide
  misc_feature (34)..(36): n is a, c, g, or t
tgcaggaccagagaattcgaatacactcacagannnacgtatgcca

SEQ ID NO: 1960 - DNA, 46 bp, Artificial Sequence
  Synthesized adaptor olignonucleotide
  misc_feature (34)..(36): n is a, c, g, or t
tgcaggaccagagaattcgaatacagccggtgtnnnacgtatgcca

SEQ ID NO: 1961 - DNA, 46 bp, Artificial Sequence
  Synthesized adaptor olignonucleotide
  misc_feature (34)..(36): n is a, c, g, or t
tgcaggaccagagaattcgaatacatacgtcagnnnacgtatgcca

SEQ ID NO: 1962 - DNA, 46 bp, Artificial Sequence
  Synthesized adaptor olignonucleotide
  misc_feature (34)..(36): n is a, c, g, or t
tgcaggaccagagaattcgaatacatctgctcannnacgtatgcca

SEQ ID NO: 1963 - DNA, 46 bp, Artificial Sequence
  Synthesized adaptor olignonucleotide
  misc_feature (34)..(36): n is a, c, g, or t
tgcaggaccagagaattcgaatacaacgtatatnnnacgtatgcca

SEQ ID NO: 1964 - DNA, 46 bp, Artificial Sequence
  Synthesized adaptor olignonucleotide
  misc_feature (34)..(36): n is a, c, g, or t
tgcaggaccagagaattcgaatacacgagccacnnnacgtatgcca

SEQ ID NO: 1965 - DNA, 46 bp, Artificial Sequence
  Synthesized adaptor olignonucleotide
  misc_feature (34)..(36): n is a, c, g, or t
tgcaggaccagagaattcgaatacatcgctctannnacgtatgcca

SEQ ID NO: 1966 - DNA, 46 bp, Artificial Sequence
  Synthesized adaptor olignonucleotide
  misc_feature (34)..(36): n is a, c, g, or t
tgcaggaccagagaattcgaatacacggaagatnnnacgtatgcca

SEQ ID NO: 1967 - DNA, 46 bp, Artificial Sequence
  Synthesized adaptor olignonucleotide
  misc_feature (34)..(36): n is a, c, g, or t
tgcaggaccagagaattcgaatacattagcggtnnnacgtatgcca

SEQ ID NO: 1968 - DNA, 46 bp, Artificial Sequence
  Synthesized adaptor olignonucleotide
  misc_feature (34)..(36): n is a, c, g, or t
tgcaggaccagagaattcgaatacatgagctcannnacgtatgcca

SEQ ID NO: 1969 - DNA, 46 bp, Artificial Sequence
  Synthesized adaptor olignonucleotide
  misc_feature (34)..(36): n is a, c, g, or t
tgcaggaccagagaattcgaatacatacacgtgnnnacgtatgcca

SEQ ID NO: 1970 - DNA, 46 bp, Artificial Sequence
  Synthesized adaptor olignonucleotide
  misc_feature (34)..(36): n is a, c, g, or t
tgcaggaccagagaattcgaatacatagtgtatnnnacgtatgcca

SEQ ID NO: 1971 - DNA, 46 bp, Artificial Sequence
  Synthesized adaptor olignonucleotide
  misc_feature (34)..(36): n is a, c, g, or t
tgcaggaccagagaattcgaatacacattaggcnnnacgtatgcca

SEQ ID NO: 1972 - DNA, 46 bp, Artificial Sequence
  Synthesized adaptor olignonucleotide
  misc_feature (34)..(36): n is a, c, g, or t
tgcaggaccagagaattcgaatacaacaccacannnacgtatgcca

SEQ ID NO: 1973 - DNA, 46 bp, Artificial Sequence
  Synthesized adaptor olignonucleotide
  misc_feature (34)..(36): n is a, c, g, or t
tgcaggaccagagaattcgaatacagtgcgtcgnnnacgtatgcca

SEQ ID NO: 1974 - DNA, 46 bp, Artificial Sequence
  Synthesized adaptor olignonucleotide
  misc_feature (34)..(36): n is a, c, g, or t
tgcaggaccagagaattcgaatacatatgtttcnnnacgtatgcca

SEQ ID NO: 1975 - DNA, 46 bp, Artificial Sequence
  Synthesized adaptor olignonucleotide
  misc_feature (34)..(36): n is a, c, g, or t
tgcaggaccagagaattcgaatacagtggtcgcnnnacgtatgcca

SEQ ID NO: 1976 - DNA, 46 bp, Artificial Sequence
  Synthesized adaptor olignonucleotide
  misc_feature (34)..(36): n is a, c, g, or t
tgcaggaccagagaattcgaatacactggaccgnnnacgtatgcca

SEQ ID NO: 1977 - DNA, 46 bp, Artificial Sequence
  Synthesized adaptor olignonucleotide
  misc_feature (34)..(36): n is a, c, g, or t
tgcaggaccagagaattcgaatacaggcgtgtcnnnacgtatgcca

SEQ ID NO: 1978 - DNA, 46 bp, Artificial Sequence
  Synthesized adaptor olignonucleotide
  misc_feature (34)..(36): n is a, c, g, or t
tgcaggaccagagaattcgaatacaagtctaatnnnacgtatgcca

SEQ ID NO: 1979 - DNA, 46 bp, Artificial Sequence
  Synthesized adaptor olignonucleotide
  misc_feature (34)..(36): n is a, c, g, or t
tgcaggaccagagaattcgaatacactcatgctnnnacgtatgcca

SEQ ID NO: 1980 - DNA, 46 bp, Artificial Sequence
  Synthesized adaptor olignonucleotide
  misc_feature (34)..(36): n is a, c, g, or t
tgcaggaccagagaattcgaatacaagttctccnnnacgtatgcca

SEQ ID NO: 1981 - DNA, 46 bp, Artificial Sequence
  Synthesized adaptor olignonucleotide
  misc_feature (34)..(36): n is a, c, g, or t
tgcaggaccagagaattcgaatacagtgaaggtnnnacgtatgcca

SEQ ID NO: 1982 - DNA, 46 bp, Artificial Sequence
  Synthesized adaptor olignonucleotide
  misc_feature (34)..(36): n is a, c, g, or t
tgcaggaccagagaattcgaatacagttttaagnnnacgtatgcca

SEQ ID NO: 1983 - DNA, 46 bp, Artificial Sequence
  Synthesized adaptor olignonucleotide
  misc_feature (34)..(36): n is a, c, g, or t
tgcaggaccagagaattcgaatacaaaagcaatnnnacgtatgcca

SEQ ID NO: 1984 - DNA, 46 bp, Artificial Sequence
  Synthesized adaptor olignonucleotide
  misc_feature (34)..(36): n is a, c, g, or t
tgcaggaccagagaattcgaatacatgaagcgannnacgtatgcca

SEQ ID NO: 1985 - DNA, 46 bp, Artificial Sequence
  Synthesized adaptor olignonucleotide
  misc_feature (34)..(36): n is a, c, g, or t
tgcaggaccagagaattcgaatacagtagtgctnnnacgtatgcca

SEQ ID NO: 1986 - DNA, 46 bp, Artificial Sequence
  Synthesized adaptor olignonucleotide
  misc_feature (34)..(36): n is a, c, g, or t
tgcaggaccagagaattcgaatacaactatgtannnacgtatgcca

SEQ ID NO: 1987 - DNA, 46 bp, Artificial Sequence
  Synthesized adaptor olignonucleotide
  misc_feature (34)..(36): n is a, c, g, or t
tgcaggaccagagaattcgaatacagaagttccnnnacgtatgcca

SEQ ID NO: 1988 - DNA, 46 bp, Artificial Sequence
  Synthesized adaptor olignonucleotide
  misc_feature (34)..(36): n is a, c, g, or t
tgcaggaccagagaattcgaatacacggtgctgnnnacgtatgcca

SEQ ID NO: 1989 - DNA, 46 bp, Artificial Sequence
  Synthesized adaptor olignonucleotide
  misc_feature (34)..(36): n is a, c, g, or t
tgcaggaccagagaattcgaatacatgcaaattnnnctagcgttac

SEQ ID NO: 1990 - DNA, 46 bp, Artificial Sequence
  Synthesized adaptor olignonucleotide
  misc_feature (34)..(36): n is a, c, g, or t
tgcaggaccagagaattcgaatacaacttgtggnnnctagcgttac

SEQ ID NO: 1991 - DNA, 46 bp, Artificial Sequence
  Synthesized adaptor olignonucleotide
  misc_feature (34)..(36): n is a, c, g, or t
tgcaggaccagagaattcgaatacatcgctgccnnnctagcgttac

SEQ ID NO: 1992 - DNA, 46 bp, Artificial Sequence
  Synthesized adaptor olignonucleotide
  misc_feature (34)..(36): n is a, c, g, or t
tgcaggaccagagaattcgaatacatcccttctnnnctagcgttac

SEQ ID NO: 1993 - DNA, 46 bp, Artificial Sequence
  Synthesized adaptor olignonucleotide
  misc_feature (34)..(36): n is a, c, g, or t
tgcaggaccagagaattcgaatacacggtactannnctagcgttac

SEQ ID NO: 1994 - DNA, 46 bp, Artificial Sequence
  Synthesized adaptor olignonucleotide
  misc_feature (34)..(36): n is a, c, g, or t
tgcaggaccagagaattcgaatacaagatatctnnnctagcgttac

SEQ ID NO: 1995 - DNA, 46 bp, Artificial Sequence
  Synthesized adaptor olignonucleotide
  misc_feature (34)..(36): n is a, c, g, or t
tgcaggaccagagaattcgaatacactcaagtgnnnctagcgttac

SEQ ID NO: 1996 - DNA, 46 bp, Artificial Sequence
  Synthesized adaptor olignonucleotide
  misc_feature (34)..(36): n is a, c, g, or t
tgcaggaccagagaattcgaatacaacctcctannnctagcgttac

SEQ ID NO: 1997 - DNA, 46 bp, Artificial Sequence
  Synthesized adaptor olignonucleotide
  misc_feature (34)..(36): n is a, c, g, or t
tgcaggaccagagaattcgaatacaagcaatttnnnctagcgttac

SEQ ID NO: 1998 - DNA, 46 bp, Artificial Sequence
  Synthesized adaptor olignonucleotide
  misc_feature (34)..(36): n is a, c, g, or t
tgcaggaccagagaattcgaatacagccccgaannnctagcgttac

SEQ ID NO: 1999 - DNA, 46 bp, Artificial Sequence
  Synthesized adaptor olignonucleotide
  misc_feature (34)..(36): n is a, c, g, or t
tgcaggaccagagaattcgaatacaccaaatcgnnnctagcgttac

SEQ ID NO: 2000 - DNA, 46 bp, Artificial Sequence
  Synthesized adaptor olignonucleotide
  misc_feature (34)..(36): n is a, c, g, or t
tgcaggaccagagaattcgaatacagatcggttnnnctagcgttac

SEQ ID NO: 2001 - DNA, 46 bp, Artificial Sequence
  Synthesized adaptor olignonucleotide
  misc_feature (34)..(36): n is a, c, g, or t
tgcaggaccagagaattcgaatacaacccctgcnnnctagcgttac

SEQ ID NO: 2002 - DNA, 46 bp, Artificial Sequence
  Synthesized adaptor olignonucleotide
  misc_feature (34)..(36): n is a, c, g, or t
tgcaggaccagagaattcgaatacaacccacttnnnctagcgttac

SEQ ID NO: 2003 - DNA, 46 bp, Artificial Sequence
  Synthesized adaptor olignonucleotide
  misc_feature (34)..(36): n is a, c, g, or t
tgcaggaccagagaattcgaatacaagaccttgnnnctagcgttac

SEQ ID NO: 2004 - DNA, 46 bp, Artificial Sequence
  Synthesized adaptor olignonucleotide
  misc_feature (34)..(36): n is a, c, g, or t
tgcaggaccagagaattcgaatacaccttgatcnnnctagcgttac

SEQ ID NO: 2005 - DNA, 46 bp, Artificial Sequence
  Synthesized adaptor olignonucleotide
  misc_feature (34)..(36): n is a, c, g, or t
tgcaggaccagagaattcgaatacaaagtattcnnnctagcgttac

SEQ ID NO: 2006 - DNA, 46 bp, Artificial Sequence
  Synthesized adaptor olignonucleotide
  misc_feature (34)..(36): n is a, c, g, or t
tgcaggaccagagaattcgaatacacatccaagnnnctagcgttac

SEQ ID NO: 2007 - DNA, 46 bp, Artificial Sequence
  Synthesized adaptor olignonucleotide
  misc_feature (34)..(36): n is a, c, g, or t
tgcaggaccagagaattcgaatacacacaagtcnnnctagcgttac

SEQ ID NO: 2008 - DNA, 46 bp, Artificial Sequence
  Synthesized adaptor olignonucleotide
  misc_feature (34)..(36): n is a, c, g, or t
tgcaggaccagagaattcgaatacataaaatggnnnctagcgttac

SEQ ID NO: 2009 - DNA, 46 bp, Artificial Sequence
  Synthesized adaptor olignonucleotide
  misc_feature (34)..(36): n is a, c, g, or t
tgcaggaccagagaattcgaatacaatctacaannnctagcgttac

SEQ ID NO: 2010 - DNA, 46 bp, Artificial Sequence
  Synthesized adaptor olignonucleotide
  misc_feature (34)..(36): n is a, c, g, or t
tgcaggaccagagaattcgaatacagcgagaatnnnctagcgttac

SEQ ID NO: 2011 - DNA, 46 bp, Artificial Sequence
  Synthesized adaptor olignonucleotide
  misc_feature (34)..(36): n is a, c, g, or t
tgcaggaccagagaattcgaatacagtagccatnnnctagcgttac

SEQ ID NO: 2012 - DNA, 46 bp, Artificial Sequence
  Synthesized adaptor olignonucleotide
  misc_feature (34)..(36): n is a, c, g, or t
tgcaggaccagagaattcgaatacaaaggcagtnnnctagcgttac

SEQ ID NO: 2013 - DNA, 46 bp, Artificial Sequence
  Synthesized adaptor olignonucleotide
  misc_feature (34)..(36): n is a, c, g, or t
tgcaggaccagagaattcgaatacagtagactcnnnctagcgttac

SEQ ID NO: 2014 - DNA, 46 bp, Artificial Sequence
  Synthesized adaptor olignonucleotide
  misc_feature (34)..(36): n is a, c, g, or t
tgcaggaccagagaattcgaatacaggtatgctnnnctagcgttac

SEQ ID NO: 2015 - DNA, 46 bp, Artificial Sequence
  Synthesized adaptor olignonucleotide
  misc_feature (34)..(36): n is a, c, g, or t
tgcaggaccagagaattcgaatacaggttttaannnctagcgttac

SEQ ID NO: 2016 - DNA, 46 bp, Artificial Sequence
  Synthesized adaptor olignonucleotide
  misc_feature (34)..(36): n is a, c, g, or t
tgcaggaccagagaattcgaatacaacagaagcnnnctagcgttac

SEQ ID NO: 2017 - DNA, 46 bp, Artificial Sequence
  Synthesized adaptor olignonucleotide
  misc_feature (34)..(36): n is a, c, g, or t
tgcaggaccagagaattcgaatacacagcacgcnnnctagcgttac

SEQ ID NO: 2018 - DNA, 46 bp, Artificial Sequence
  Synthesized adaptor olignonucleotide
  misc_feature (34)..(36): n is a, c, g, or t
tgcaggaccagagaattcgaatacaaccgtaacnnnctagcgttac

SEQ ID NO: 2019 - DNA, 46 bp, Artificial Sequence
  Synthesized adaptor olignonucleotide
  misc_feature (34)..(36): n is a, c, g, or t
tgcaggaccagagaattcgaatacaggaagccgnnnctagcgttac

SEQ ID NO: 2020 - DNA, 46 bp, Artificial Sequence
  Synthesized adaptor olignonucleotide
  misc_feature (34)..(36): n is a, c, g, or t
tgcaggaccagagaattcgaatacagaggatcannnctagcgttac

SEQ ID NO: 2021 - DNA, 46 bp, Artificial Sequence
  Synthesized adaptor olignonucleotide
  misc_feature (34)..(36): n is a, c, g, or t
tgcaggaccagagaattcgaatacacggttcggnnnctagcgttac

SEQ ID NO: 2022 - DNA, 46 bp, Artificial Sequence
  Synthesized adaptor olignonucleotide
  misc_feature (34)..(36): n is a, c, g, or t
tgcaggaccagagaattcgaatacaatccacagnnnctagcgttac

SEQ ID NO: 2023 - DNA, 46 bp, Artificial Sequence
  Synthesized adaptor olignonucleotide
  misc_feature (34)..(36): n is a, c, g, or t
tgcaggaccagagaattcgaatacagagaccccnnnctagcgttac

SEQ ID NO: 2024 - DNA, 46 bp, Artificial Sequence
  Synthesized adaptor olignonucleotide
  misc_feature (34)..(36): n is a, c, g, or t
tgcaggaccagagaattcgaatacactccggagnnnctagcgttac

SEQ ID NO: 2025 - DNA, 46 bp, Artificial Sequence
  Synthesized adaptor olignonucleotide
  misc_feature (34)..(36): n is a, c, g, or t
tgcaggaccagagaattcgaatacatcgcctcgnnnctagcgttac

SEQ ID NO: 2026 - DNA, 46 bp, Artificial Sequence
  Synthesized adaptor olignonucleotide
  misc_feature (34)..(36): n is a, c, g, or t
tgcaggaccagagaattcgaatacatcattccgnnnctagcgttac

SEQ ID NO: 2027 - DNA, 46 bp, Artificial Sequence
  Synthesized adaptor olignonucleotide
  misc_feature (34)..(36): n is a, c, g, or t
tgcaggaccagagaattcgaatacagaactaccnnnctagcgttac

SEQ ID NO: 2028 - DNA, 46 bp, Artificial Sequence
  Synthesized adaptor olignonucleotide
  misc_feature (34)..(36): n is a, c, g, or t
tgcaggaccagagaattcgaatacataatttttnnnctagcgttac

SEQ ID NO: 2029 - DNA, 46 bp, Artificial Sequence
  Synthesized adaptor olignonucleotide
  misc_feature (34)..(36): n is a, c, g, or t
tgcaggaccagagaattcgaatacagattgtgcnnnctagcgttac

SEQ ID NO: 2030 - DNA, 46 bp, Artificial Sequence
  Synthesized adaptor olignonucleotide
  misc_feature (34)..(36): n is a, c, g, or t
tgcaggaccagagaattcgaatacatggcgcacnnnctagcgttac

SEQ ID NO: 2031 - DNA, 46 bp, Artificial Sequence
  Synthesized adaptor olignonucleotide
  misc_feature (34)..(36): n is a, c, g, or t
tgcaggaccagagaattcgaatacaaaatcagannnctagcgttac

SEQ ID NO: 2032 - DNA, 46 bp, Artificial Sequence
  Synthesized adaptor olignonucleotide
  misc_feature (34)..(36): n is a, c, g, or t
tgcaggaccagagaattcgaatacaaggctatcnnnctagcgttac

SEQ ID NO: 2033 - DNA, 46 bp, Artificial Sequence
  Synthesized adaptor olignonucleotide
  misc_feature (34)..(36): n is a, c, g, or t
tgcaggaccagagaattcgaatacatcttgtgcnnnctagcgttac

SEQ ID NO: 2034 - DNA, 46 bp, Artificial Sequence
  Synthesized adaptor olignonucleotide
  misc_feature (34)..(36): n is a, c, g, or t
tgcaggaccagagaattcgaatacaccattccannnctagcgttac

SEQ ID NO: 2035 - DNA, 46 bp, Artificial Sequence
  Synthesized adaptor olignonucleotide
  misc_feature (34)..(36): n is a, c, g, or t
tgcaggaccagagaattcgaatacatagattacnnnctagcgttac

SEQ ID NO: 2036 - DNA, 46 bp, Artificial Sequence
  Synthesized adaptor olignonucleotide
  misc_feature (34)..(36): n is a, c, g, or t
tgcaggaccagagaattcgaatacagtttgctcnnnctagcgttac

SEQ ID NO: 2037 - DNA, 46 bp, Artificial Sequence
  Synthesized adaptor olignonucleotide
  misc_feature (34)..(36): n is a, c, g, or t
tgcaggaccagagaattcgaatacatcttcggtnnnctagcgttac

SEQ ID NO: 2038 - DNA, 46 bp, Artificial Sequence
  Synthesized adaptor olignonucleotide
  misc_feature (34)..(36): n is a, c, g, or t
tgcaggaccagagaattcgaatacaagtagtccnnnctagcgttac

SEQ ID NO: 2039 - DNA, 46 bp, Artificial Sequence
  Synthesized adaptor olignonucleotide
  misc_feature (34)..(36): n is a, c, g, or t
tgcaggaccagagaattcgaatacacggtgtatnnnctagcgttac

SEQ ID NO: 2040 - DNA, 46 bp, Artificial Sequence
  Synthesized adaptor olignonucleotide
  misc_feature (34)..(36): n is a, c, g, or t
tgcaggaccagagaattcgaatacactgtttgcnnnctagcgttac

SEQ ID NO: 2041 - DNA, 46 bp, Artificial Sequence
  Synthesized adaptor olignonucleotide
  misc_feature (34)..(36): n is a, c, g, or t
tgcaggaccagagaattcgaatacaaacgttgcnnnctagcgttac

SEQ ID NO: 2042 - DNA, 46 bp, Artificial Sequence
  Synthesized adaptor olignonucleotide
  misc_feature (34)..(36): n is a, c, g, or t
tgcaggaccagagaattcgaatacaataaatggnnnctagcgttac

SEQ ID NO: 2043 - DNA, 46 bp, Artificial Sequence
  Synthesized adaptor olignonucleotide
  misc_feature (34)..(36): n is a, c, g, or t
tgcaggaccagagaattcgaatacaacgcgtgcnnnctagcgttac

SEQ ID NO: 2044 - DNA, 46 bp, Artificial Sequence
  Synthesized adaptor olignonucleotide
  misc_feature (34)..(36): n is a, c, g, or t
tgcaggaccagagaattcgaatacacgttggtannnctagcgttac

SEQ ID NO: 2045 - DNA, 46 bp, Artificial Sequence
  Synthesized adaptor olignonucleotide
  misc_feature (34)..(36): n is a, c, g, or t
tgcaggaccagagaattcgaatacaaggcgtaannnctagcgttac

SEQ ID NO: 2046 - DNA, 46 bp, Artificial Sequence
  Synthesized adaptor olignonucleotide
  misc_feature (34)..(36): n is a, c, g, or t
tgcaggaccagagaattcgaatacatgcctatcnnnctagcgttac

SEQ ID NO: 2047 - DNA, 46 bp, Artificial Sequence
  Synthesized adaptor olignonucleotide
  misc_feature (34)..(36): n is a, c, g, or t
tgcaggaccagagaattcgaatacaaaagctccnnnctagcgttac

SEQ ID NO: 2048 - DNA, 46 bp, Artificial Sequence
  Synthesized adaptor olignonucleotide
  misc_feature (34)..(36): n is a, c, g, or t
tgcaggaccagagaattcgaatacaaggacgatnnnctagcgttac

SEQ ID NO: 2049 - DNA, 46 bp, Artificial Sequence
  Synthesized adaptor olignonucleotide
  misc_feature (34)..(36): n is a, c, g, or t
tgcaggaccagagaattcgaatacacttgaagcnnngatcgacatg

SEQ ID NO: 2050 - DNA, 46 bp, Artificial Sequence
  Synthesized adaptor olignonucleotide
  misc_feature (34)..(36): n is a, c, g, or t
tgcaggaccagagaattcgaatacatgccctcgnnngatcgacatg

SEQ ID NO: 2051 - DNA, 46 bp, Artificial Sequence
  Synthesized adaptor olignonucleotide
  misc_feature (34)..(36): n is a, c, g, or t
tgcaggaccagagaattcgaatacaagcgaaacnnngatcgacatg

SEQ ID NO: 2052 - DNA, 46 bp, Artificial Sequence
  Synthesized adaptor olignonucleotide
  misc_feature (34)..(36): n is a, c, g, or t
tgcaggaccagagaattcgaatacatagagtggnnngatcgacatg

SEQ ID NO: 2053 - DNA, 46 bp, Artificial Sequence
  Synthesized adaptor olignonucleotide
  misc_feature (34)..(36): n is a, c, g, or t
tgcaggaccagagaattcgaatacaagcagcaannngatcgacatg

SEQ ID NO: 2054 - DNA, 46 bp, Artificial Sequence
  Synthesized adaptor olignonucleotide
  misc_feature (34)..(36): n is a, c, g, or t
tgcaggaccagagaattcgaatacacctattatnnngatcgacatg

SEQ ID NO: 2055 - DNA, 46 bp, Artificial Sequence
  Synthesized adaptor olignonucleotide
  misc_feature (34)..(36): n is a, c, g, or t
tgcaggaccagagaattcgaatacagcgacgagnnngatcgacatg

SEQ ID NO: 2056 - DNA, 46 bp, Artificial Sequence
  Synthesized adaptor olignonucleotide
  misc_feature (34)..(36): n is a, c, g, or t
tgcaggaccagagaattcgaatacaacgatttannngatcgacatg

SEQ ID NO: 2057 - DNA, 46 bp, Artificial Sequence
  Synthesized adaptor olignonucleotide
  misc_feature (34)..(36): n is a, c, g, or t
tgcaggaccagagaattcgaatacaaattgttgnnngatcgacatg

SEQ ID NO: 2058 - DNA, 46 bp, Artificial Sequence
  Synthesized adaptor olignonucleotide
  misc_feature (34)..(36): n is a, c, g, or t
tgcaggaccagagaattcgaatacacattaagtnnngatcgacatg

SEQ ID NO: 2059 - DNA, 46 bp, Artificial Sequence
  Synthesized adaptor olignonucleotide
  misc_feature (34)..(36): n is a, c, g, or t
tgcaggaccagagaattcgaatacagacggagcnnngatcgacatg

SEQ ID NO: 2060 - DNA, 46 bp, Artificial Sequence
  Synthesized adaptor olignonucleotide
  misc_feature (34)..(36): n is a, c, g, or t
tgcaggaccagagaattcgaatacaccgatagtnnngatcgacatg

SEQ ID NO: 2061 - DNA, 46 bp, Artificial Sequence
  Synthesized adaptor olignonucleotide
  misc_feature (34)..(36): n is a, c, g, or t
tgcaggaccagagaattcgaatacaagtattgtnnngatcgacatg

SEQ ID NO: 2062 - DNA, 46 bp, Artificial Sequence
  Synthesized adaptor olignonucleotide
  misc_feature (34)..(36): n is a, c, g, or t
tgcaggaccagagaattcgaatacatttcggctnnngatcgacatg

SEQ ID NO: 2063 - DNA, 46 bp, Artificial Sequence
  Synthesized adaptor olignonucleotide
  misc_feature (34)..(36): n is a, c, g, or t
tgcaggaccagagaattcgaatacagtagacagnnngatcgacatg

SEQ ID NO: 2064 - DNA, 46 bp, Artificial Sequence
  Synthesized adaptor olignonucleotide
  misc_feature (34)..(36): n is a, c, g, or t
tgcaggaccagagaattcgaatacaacgaagtgnnngatcgacatg

SEQ ID NO: 2065 - DNA, 46 bp, Artificial Sequence
  Synthesized adaptor olignonucleotide
  misc_feature (34)..(36): n is a, c, g, or t
tgcaggaccagagaattcgaatacacgtctttgnnngatcgacatg

SEQ ID NO: 2066 - DNA, 46 bp, Artificial Sequence
  Synthesized adaptor olignonucleotide
  misc_feature (34)..(36): n is a, c, g, or t
tgcaggaccagagaattcgaatacaacacaggannngatcgacatg

SEQ ID NO: 2067 - DNA, 46 bp, Artificial Sequence
  Synthesized adaptor olignonucleotide
  misc_feature (34)..(36): n is a, c, g, or t
tgcaggaccagagaattcgaatacaggtcactannngatcgacatg

SEQ ID NO: 2068 - DNA, 46 bp, Artificial Sequence
  Synthesized adaptor olignonucleotide
  misc_feature (34)..(36): n is a, c, g, or t
tgcaggaccagagaattcgaatacagaacgaacnnngatcgacatg

SEQ ID NO: 2069 - DNA, 46 bp, Artificial Sequence
  Synthesized adaptor olignonucleotide
  misc_feature (34)..(36): n is a, c, g, or t
tgcaggaccagagaattcgaatacacctaactcnnngatcgacatg

SEQ ID NO: 2070 - DNA, 46 bp, Artificial Sequence
  Synthesized adaptor olignonucleotide
  misc_feature (34)..(36): n is a, c, g, or t
tgcaggaccagagaattcgaatacaaagactttnnngatcgacatg

SEQ ID NO: 2071 - DNA, 46 bp, Artificial Sequence
  Synthesized adaptor olignonucleotide
  misc_feature (34)..(36): n is a, c, g, or t
tgcaggaccagagaattcgaatacaggacatctnnngatcgacatg

SEQ ID NO: 2072 - DNA, 46 bp, Artificial Sequence
  Synthesized adaptor olignonucleotide
  misc_feature (34)..(36): n is a, c, g, or t
tgcaggaccagagaattcgaatacaggcgtaaannngatcgacatg

SEQ ID NO: 2073 - DNA, 46 bp, Artificial Sequence
  Synthesized adaptor olignonucleotide
  misc_feature (34)..(36): n is a, c, g, or t
tgcaggaccagagaattcgaatacagtaccagtnnngatcgacatg

SEQ ID NO: 2074 - DNA, 46 bp, Artificial Sequence
  Synthesized adaptor olignonucleotide
  misc_feature (34)..(36): n is a, c, g, or t
tgcaggaccagagaattcgaatacagaatttacnnngatcgacatg

SEQ ID NO: 2075 - DNA, 46 bp, Artificial Sequence
  Synthesized adaptor olignonucleotide
  misc_feature (34)..(36): n is a, c, g, or t
tgcaggaccagagaattcgaatacaaacacccannngatcgacatg

SEQ ID NO: 2076 - DNA, 46 bp, Artificial Sequence
  Synthesized adaptor olignonucleotide
  misc_feature (34)..(36): n is a, c, g, or t
tgcaggaccagagaattcgaatacaagttattgnnngatcgacatg

SEQ ID NO: 2077 - DNA, 46 bp, Artificial Sequence
  Synthesized adaptor olignonucleotide
  misc_feature (34)..(36): n is a, c, g, or t
tgcaggaccagagaattcgaatacacttcttttnnngatcgacatg

SEQ ID NO: 2078 - DNA, 46 bp, Artificial Sequence
  Synthesized adaptor olignonucleotide
  misc_feature (34)..(36): n is a, c, g, or t
tgcaggaccagagaattcgaatacagagctccgnnngatcgacatg

SEQ ID NO: 2079 - DNA, 46 bp, Artificial Sequence
  Synthesized adaptor olignonucleotide
  misc_feature (34)..(36): n is a, c, g, or t
tgcaggaccagagaattcgaatacagaaccccgnnngatcgacatg

SEQ ID NO: 2080 - DNA, 46 bp, Artificial Sequence
  Synthesized adaptor olignonucleotide
  misc_feature (34)..(36): n is a, c, g, or t
tgcaggaccagagaattcgaatacaattgtgatnnngatcgacatg

SEQ ID NO: 2081 - DNA, 46 bp, Artificial Sequence
  Synthesized adaptor olignonucleotide
  misc_feature (34)..(36): n is a, c, g, or t
tgcaggaccagagaattcgaatacaagttctttnnngatcgacatg

SEQ ID NO: 2082 - DNA, 46 bp, Artificial Sequence
  Synthesized adaptor olignonucleotide
  misc_feature (34)..(36): n is a, c, g, or t
tgcaggaccagagaattcgaatacagcacggtcnnngatcgacatg

SEQ ID NO: 2083 - DNA, 46 bp, Artificial Sequence
  Synthesized adaptor olignonucleotide
  misc_feature (34)..(36): n is a, c, g, or t
tgcaggaccagagaattcgaatacagtatccctnnngatcgacatg

SEQ ID NO: 2084 - DNA, 46 bp, Artificial Sequence
  Synthesized adaptor olignonucleotide
  misc_feature (34)..(36): n is a, c, g, or t
tgcaggaccagagaattcgaatacagcaagtgannngatcgacatg

SEQ ID NO: 2085 - DNA, 46 bp, Artificial Sequence
  Synthesized adaptor olignonucleotide
  misc_feature (34)..(36): n is a, c, g, or t
tgcaggaccagagaattcgaatacataagatagnnngatcgacatg

SEQ ID NO: 2086 - DNA, 46 bp, Artificial Sequence
  Synthesized adaptor olignonucleotide
  misc_feature (34)..(36): n is a, c, g, or t
tgcaggaccagagaattcgaatacagcaatctgnnngatcgacatg

SEQ ID NO: 2087 - DNA, 46 bp, Artificial Sequence
  Synthesized adaptor olignonucleotide
  misc_feature (34)..(36): n is a, c, g, or t
tgcaggaccagagaattcgaatacactgccaggnnngatcgacatg

SEQ ID NO: 2088 - DNA, 46 bp, Artificial Sequence
  Synthesized adaptor olignonucleotide
  misc_feature (34)..(36): n is a, c, g, or t
tgcaggaccagagaattcgaatacaggtttatannngatcgacatg

SEQ ID NO: 2089 - DNA, 46 bp, Artificial Sequence
  Synthesized adaptor olignonucleotide
  misc_feature (34)..(36): n is a, c, g, or t
tgcaggaccagagaattcgaatacaaacttgcgnnngatcgacatg

SEQ ID NO: 2090 - DNA, 46 bp, Artificial Sequence
  Synthesized adaptor olignonucleotide
  misc_feature (34)..(36): n is a, c, g, or t
tgcaggaccagagaattcgaatacaccaacgcgnnngatcgacatg

SEQ ID NO: 2091 - DNA, 46 bp, Artificial Sequence
  Synthesized adaptor olignonucleotide
  misc_feature (34)..(36): n is a, c, g, or t
tgcaggaccagagaattcgaatacatggaagacnnngatcgacatg

SEQ ID NO: 2092 - DNA, 46 bp, Artificial Sequence
  Synthesized adaptor olignonucleotide
  misc_feature (34)..(36): n is a, c, g, or t
tgcaggaccagagaattcgaatacaattgaagannngatcgacatg

SEQ ID NO: 2093 - DNA, 46 bp, Artificial Sequence
  Synthesized adaptor olignonucleotide
  misc_feature (34)..(36): n is a, c, g, or t
tgcaggaccagagaattcgaatacattttcacannngatcgacatg

SEQ ID NO: 2094 - DNA, 46 bp, Artificial Sequence
  Synthesized adaptor olignonucleotide
  misc_feature (34)..(36): n is a, c, g, or t
tgcaggaccagagaattcgaatacaacgaactcnnngatcgacatg

SEQ ID NO: 2095 - DNA, 46 bp, Artificial Sequence
  Synthesized adaptor olignonucleotide
  misc_feature (34)..(36): n is a, c, g, or t
tgcaggaccagagaattcgaatacaaggccgtcnnngatcgacatg

SEQ ID NO: 2096 - DNA, 46 bp, Artificial Sequence
  Synthesized adaptor olignonucleotide
  misc_feature (34)..(36): n is a, c, g, or t
tgcaggaccagagaattcgaatacattggagctnnngatcgacatg

SEQ ID NO: 2097 - DNA, 46 bp, Artificial Sequence
  Synthesized adaptor olignonucleotide
  misc_feature (34)..(36): n is a, c, g, or t
tgcaggaccagagaattcgaatacaacagacagnnngatcgacatg

SEQ ID NO: 2098 - DNA, 46 bp, Artificial Sequence
  Synthesized adaptor olignonucleotide
  misc_feature (34)..(36): n is a, c, g, or t
tgcaggaccagagaattcgaatacaatcgtcagnnngatcgacatg

SEQ ID NO: 2099 - DNA, 46 bp, Artificial Sequence
  Synthesized adaptor olignonucleotide
  misc_feature (34)..(36): n is a, c, g, or t
tgcaggaccagagaattcgaatacattatgtctnnngatcgacatg

SEQ ID NO: 2100 - DNA, 46 bp, Artificial Sequence
  Synthesized adaptor olignonucleotide
  misc_feature (34)..(36): n is a, c, g, or t
tgcaggaccagagaattcgaatacagtcacgatnnngatcgacatg

SEQ ID NO: 2101 - DNA, 46 bp, Artificial Sequence
  Synthesized adaptor olignonucleotide
  misc_feature (34)..(36): n is a, c, g, or t
tgcaggaccagagaattcgaatacacattctgcnnngatcgacatg

SEQ ID NO: 2102 - DNA, 46 bp, Artificial Sequence
  Synthesized adaptor olignonucleotide
  misc_feature (34)..(36): n is a, c, g, or t
tgcaggaccagagaattcgaatacagaaaaactnnngatcgacatg

SEQ ID NO: 2103 - DNA, 46 bp, Artificial Sequence
  Synthesized adaptor olignonucleotide
  misc_feature (34)..(36): n is a, c, g, or t
tgcaggaccagagaattcgaatacatcgtcgttnnngatcgacatg

SEQ ID NO: 2104 - DNA, 46 bp, Artificial Sequence
  Synthesized adaptor olignonucleotide
  misc_feature (34)..(36): n is a, c, g, or t
tgcaggaccagagaattcgaatacaattgtggcnnngatcgacatg

SEQ ID NO: 2105 - DNA, 46 bp, Artificial Sequence
  Synthesized adaptor olignonucleotide
  misc_feature (34)..(36): n is a, c, g, or t
tgcaggaccagagaattcgaatacaactggactnnngatcgacatg

SEQ ID NO: 2106 - DNA, 46 bp, Artificial Sequence
  Synthesized adaptor olignonucleotide
  misc_feature (34)..(36): n is a, c, g, or t
tgcaggaccagagaattcgaatacacgttgttcnnngatcgacatg

SEQ ID NO: 2107 - DNA, 46 bp, Artificial Sequence
  Synthesized adaptor olignonucleotide
  misc_feature (34)..(36): n is a, c, g, or t
tgcaggaccagagaattcgaatacacaagacctnnngatcgacatg

SEQ ID NO: 2108 - DNA, 46 bp, Artificial Sequence
  Synthesized adaptor olignonucleotide
  misc_feature (34)..(36): n is a, c, g, or t
tgcaggaccagagaattcgaatacatacccccgnnngatcgacatg

SEQ ID NO: 2109 - DNA, 46 bp, Artificial Sequence
  Synthesized adaptor olignonucleotide
  misc_feature (34)..(36): n is a, c, g, or t
tgcaggaccagagaattcgaatacacctaccgcnnntgcatcaggt

SEQ ID NO: 2110 - DNA, 46 bp, Artificial Sequence
  Synthesized adaptor olignonucleotide
  misc_feature (34)..(36): n is a, c, g, or t
tgcaggaccagagaattcgaatacaagacagtgnnntgcatcaggt

SEQ ID NO: 2111 - DNA, 46 bp, Artificial Sequence
  Synthesized adaptor olignonucleotide
  misc_feature (34)..(36): n is a, c, g, or t
tgcaggaccagagaattcgaatacagtcctatcnnntgcatcaggt

SEQ ID NO: 2112 - DNA, 46 bp, Artificial Sequence
  Synthesized adaptor olignonucleotide
  misc_feature (34)..(36): n is a, c, g, or t
tgcaggaccagagaattcgaatacacgcgctctnnntgcatcaggt

SEQ ID NO: 2113 - DNA, 46 bp, Artificial Sequence
  Synthesized adaptor olignonucleotide
  misc_feature (34)..(36): n is a, c, g, or t
tgcaggaccagagaattcgaatacattgattctnnntgcatcaggt

SEQ ID NO: 2114 - DNA, 46 bp, Artificial Sequence
  Synthesized adaptor olignonucleotide
  misc_feature (34)..(36): n is a, c, g, or t
tgcaggaccagagaattcgaatacaataatgtcnnntgcatcaggt

SEQ ID NO: 2115 - DNA, 46 bp, Artificial Sequence
  Synthesized adaptor olignonucleotide
  misc_feature (34)..(36): n is a, c, g, or t
tgcaggaccagagaattcgaatacagagttaaannntgcatcaggt

SEQ ID NO: 2116 - DNA, 46 bp, Artificial Sequence
  Synthesized adaptor olignonucleotide
  misc_feature (34)..(36): n is a, c, g, or t
tgcaggaccagagaattcgaatacacgacacatnnntgcatcaggt

SEQ ID NO: 2117 - DNA, 46 bp, Artificial Sequence
  Synthesized adaptor olignonucleotide
  misc_feature (34)..(36): n is a, c, g, or t
tgcaggaccagagaattcgaatacattggccggnnntgcatcaggt

SEQ ID NO: 2118 - DNA, 46 bp, Artificial Sequence
  Synthesized adaptor olignonucleotide
  misc_feature (34)..(36): n is a, c, g, or t
tgcaggaccagagaattcgaatacagaactttannntgcatcaggt

SEQ ID NO: 2119 - DNA, 46 bp, Artificial Sequence
  Synthesized adaptor olignonucleotide
  misc_feature (34)..(36): n is a, c, g, or t
tgcaggaccagagaattcgaatacaccaaaaccnnntgcatcaggt

SEQ ID NO: 2120 - DNA, 46 bp, Artificial Sequence
  Synthesized adaptor olignonucleotide
  misc_feature (34)..(36): n is a, c, g, or t
tgcaggaccagagaattcgaatacaataccagcnnntgcatcaggt

SEQ ID NO: 2121 - DNA, 46 bp, Artificial Sequence
  Synthesized adaptor olignonucleotide
  misc_feature (34)..(36): n is a, c, g, or t
tgcaggaccagagaattcgaatacaagtagaatnnntgcatcaggt

SEQ ID NO: 2122 - DNA, 46 bp, Artificial Sequence
  Synthesized adaptor olignonucleotide
  misc_feature (34)..(36): n is a, c, g, or t
tgcaggaccagagaattcgaatacagtactacgnnntgcatcaggt

SEQ ID NO: 2123 - DNA, 46 bp, Artificial Sequence
  Synthesized adaptor olignonucleotide
  misc_feature (34)..(36): n is a, c, g, or t
tgcaggaccagagaattcgaatacattcatgaannntgcatcaggt

SEQ ID NO: 2124 - DNA, 46 bp, Artificial Sequence
  Synthesized adaptor olignonucleotide
  misc_feature (34)..(36): n is a, c, g, or t
tgcaggaccagagaattcgaatacacctaaggtnnntgcatcaggt

SEQ ID NO: 2125 - DNA, 46 bp, Artificial Sequence
  Synthesized adaptor olignonucleotide
  misc_feature (34)..(36): n is a, c, g, or t
tgcaggaccagagaattcgaatacaacaaaggcnnntgcatcaggt

SEQ ID NO: 2126 - DNA, 46 bp, Artificial Sequence
  Synthesized adaptor olignonucleotide
  misc_feature (34)..(36): n is a, c, g, or t
tgcaggaccagagaattcgaatacagaggcagcnnntgcatcaggt

SEQ ID NO: 2127 - DNA, 46 bp, Artificial Sequence
  Synthesized adaptor olignonucleotide
  misc_feature (34)..(36): n is a, c, g, or t
tgcaggaccagagaattcgaatacactactcgtnnntgcatcaggt

SEQ ID NO: 2128 - DNA, 46 bp, Artificial Sequence
  Synthesized adaptor olignonucleotide
  misc_feature (34)..(36): n is a, c, g, or t
tgcaggaccagagaattcgaatacaggtagtgannntgcatcaggt

SEQ ID NO: 2129 - DNA, 46 bp, Artificial Sequence
  Synthesized adaptor olignonucleotide
  misc_feature (34)..(36): n is a, c, g, or t
tgcaggaccagagaattcgaatacaccaccaccnnntgcatcaggt

SEQ ID NO: 2130 - DNA, 46 bp, Artificial Sequence
  Synthesized adaptor olignonucleotide
  misc_feature (34)..(36): n is a, c, g, or t
tgcaggaccagagaattcgaatacatgtgtgacnnntgcatcaggt

SEQ ID NO: 2131 - DNA, 46 bp, Artificial Sequence
  Synthesized adaptor olignonucleotide
  misc_feature (34)..(36): n is a, c, g, or t
tgcaggaccagagaattcgaatacacaccctgcnnntgcatcaggt

SEQ ID NO: 2132 - DNA, 46 bp, Artificial Sequence
  Synthesized adaptor olignonucleotide
  misc_feature (34)..(36): n is a, c, g, or t
tgcaggaccagagaattcgaatacatcgccattnnntgcatcaggt

SEQ ID NO: 2133 - DNA, 46 bp, Artificial Sequence
  Synthesized adaptor olignonucleotide
  misc_feature (34)..(36): n is a, c, g, or t
tgcaggaccagagaattcgaatacaacttcgctnnntgcatcaggt

SEQ ID NO: 2134 - DNA, 46 bp, Artificial Sequence
  Synthesized adaptor olignonucleotide
  misc_feature (34)..(36): n is a, c, g, or t
tgcaggaccagagaattcgaatacattgctttannntgcatcaggt

SEQ ID NO: 2135 - DNA, 46 bp, Artificial Sequence
  Synthesized adaptor olignonucleotide
  misc_feature (34)..(36): n is a, c, g, or t
tgcaggaccagagaattcgaatacagcacgaggnnntgcatcaggt

SEQ ID NO: 2136 - DNA, 46 bp, Artificial Sequence
  Synthesized adaptor olignonucleotide
  misc_feature (34)..(36): n is a, c, g, or t
tgcaggaccagagaattcgaatacacgaatgtcnnntgcatcaggt

SEQ ID NO: 2137 - DNA, 46 bp, Artificial Sequence
  Synthesized adaptor olignonucleotide
  misc_feature (34)..(36): n is a, c, g, or t
tgcaggaccagagaattcgaatacatggctagtnnntgcatcaggt

SEQ ID NO: 2138 - DNA, 46 bp, Artificial Sequence
  Synthesized adaptor olignonucleotide
  misc_feature (34)..(36): n is a, c, g, or t
tgcaggaccagagaattcgaatacagtgttatannntgcatcaggt

SEQ ID NO: 2139 - DNA, 46 bp, Artificial Sequence
  Synthesized adaptor olignonucleotide
  misc_feature (34)..(36): n is a, c, g, or t
tgcaggaccagagaattcgaatacattccttccnnntgcatcaggt

SEQ ID NO: 2140 - DNA, 46 bp, Artificial Sequence
  Synthesized adaptor olignonucleotide
  misc_feature (34)..(36): n is a, c, g, or t
tgcaggaccagagaattcgaatacatcaactaannntgcatcaggt

SEQ ID NO: 2141 - DNA, 46 bp, Artificial Sequence
  Synthesized adaptor olignonucleotide
  misc_feature (34)..(36): n is a, c, g, or t
tgcaggaccagagaattcgaatacatttacaagnnntgcatcaggt

SEQ ID NO: 2142 - DNA, 46 bp, Artificial Sequence
  Synthesized adaptor olignonucleotide
  misc_feature (34)..(36): n is a, c, g, or t
tgcaggaccagagaattcgaatacatcctgccgnnntgcatcaggt

SEQ ID NO: 2143 - DNA, 46 bp, Artificial Sequence
  Synthesized adaptor olignonucleotide
  misc_feature (34)..(36): n is a, c, g, or t
tgcaggaccagagaattcgaatacatcggctaannntgcatcaggt

SEQ ID NO: 2144 - DNA, 46 bp, Artificial Sequence
  Synthesized adaptor olignonucleotide
  misc_feature (34)..(36): n is a, c, g, or t
tgcaggaccagagaattcgaatacaaggagcatnnntgcatcaggt

SEQ ID NO: 2145 - DNA, 46 bp, Artificial Sequence
  Synthesized adaptor olignonucleotide
  misc_feature (34)..(36): n is a, c, g, or t
tgcaggaccagagaattcgaatacaggaatacgnnntgcatcaggt

SEQ ID NO: 2146 - DNA, 46 bp, Artificial Sequence
  Synthesized adaptor olignonucleotide
  misc_feature (34)..(36): n is a, c, g, or t
tgcaggaccagagaattcgaatacatgagacgannntgcatcaggt

SEQ ID NO: 2147 - DNA, 46 bp, Artificial Sequence
  Synthesized adaptor olignonucleotide
  misc_feature (34)..(36): n is a, c, g, or t
tgcaggaccagagaattcgaatacaccaccaggnnntgcatcaggt

SEQ ID NO: 2148 - DNA, 46 bp, Artificial Sequence
  Synthesized adaptor olignonucleotide
  misc_feature (34)..(36): n is a, c, g, or t
tgcaggaccagagaattcgaatacaagctcatgnnntgcatcaggt

SEQ ID NO: 2149 - DNA, 46 bp, Artificial Sequence
  Synthesized adaptor olignonucleotide
  misc_feature (34)..(36): n is a, c, g, or t
tgcaggaccagagaattcgaatacatataccggnnntgcatcaggt

SEQ ID NO: 2150 - DNA, 46 bp, Artificial Sequence
  Synthesized adaptor olignonucleotide
  misc_feature (34)..(36): n is a, c, g, or t
tgcaggaccagagaattcgaatacagatgccatnnntgcatcaggt

SEQ ID NO: 2151 - DNA, 46 bp, Artificial Sequence
  Synthesized adaptor olignonucleotide
  misc_feature (34)..(36): n is a, c, g, or t
tgcaggaccagagaattcgaatacattgagctgnnntgcatcaggt

SEQ ID NO: 2152 - DNA, 46 bp, Artificial Sequence
  Synthesized adaptor olignonucleotide
  misc_feature (34)..(36): n is a, c, g, or t
tgcaggaccagagaattcgaatacataaatggannntgcatcaggt

SEQ ID NO: 2153 - DNA, 46 bp, Artificial Sequence
  Synthesized adaptor olignonucleotide
  misc_feature (34)..(36): n is a, c, g, or t
tgcaggaccagagaattcgaatacaacatgaaannntgcatcaggt

SEQ ID NO: 2154 - DNA, 46 bp, Artificial Sequence
  Synthesized adaptor olignonucleotide
  misc_feature (34)..(36): n is a, c, g, or t
tgcaggaccagagaattcgaatacactcggagcnnntgcatcaggt

SEQ ID NO: 2155 - DNA, 46 bp, Artificial Sequence
  Synthesized adaptor olignonucleotide
  misc_feature (34)..(36): n is a, c, g, or t
tgcaggaccagagaattcgaatacagtttcctgnnntgcatcaggt

SEQ ID NO: 2156 - DNA, 46 bp, Artificial Sequence
  Synthesized adaptor olignonucleotide
  misc_feature (34)..(36): n is a, c, g, or t
tgcaggaccagagaattcgaatacacaacatgcnnntgcatcaggt

SEQ ID NO: 2157 - DNA, 46 bp, Artificial Sequence
  Synthesized adaptor olignonucleotide
  misc_feature (34)..(36): n is a, c, g, or t
tgcaggaccagagaattcgaatacatggtgcgcnnntgcatcaggt

SEQ ID NO: 2158 - DNA, 46 bp, Artificial Sequence
  Synthesized adaptor olignonucleotide
  misc_feature (34)..(36): n is a, c, g, or t
tgcaggaccagagaattcgaatacatacggagannntgcatcaggt

SEQ ID NO: 2159 - DNA, 46 bp, Artificial Sequence
  Synthesized adaptor olignonucleotide
  misc_feature (34)..(36): n is a, c, g, or t
tgcaggaccagagaattcgaatacaggcgtggannntgcatcaggt

SEQ ID NO: 2160 - DNA, 46 bp, Artificial Sequence
  Synthesized adaptor olignonucleotide
  misc_feature (34)..(36): n is a, c, g, or t
tgcaggaccagagaattcgaatacatctaacggnnntgcatcaggt

SEQ ID NO: 2161 - DNA, 46 bp, Artificial Sequence
  Synthesized adaptor olignonucleotide
  misc_feature (34)..(36): n is a, c, g, or t
tgcaggaccagagaattcgaatacatatagcatnnntgcatcaggt

SEQ ID NO: 2162 - DNA, 46 bp, Artificial Sequence
  Synthesized adaptor olignonucleotide
  misc_feature (34)..(36): n is a, c, g, or t
tgcaggaccagagaattcgaatacacgctccgtnnntgcatcaggt

SEQ ID NO: 2163 - DNA, 46 bp, Artificial Sequence
  Synthesized adaptor olignonucleotide
  misc_feature (34)..(36): n is a, c, g, or t
tgcaggaccagagaattcgaatacaatacatgtnnntgcatcaggt

SEQ ID NO: 2164 - DNA, 46 bp, Artificial Sequence
  Synthesized adaptor olignonucleotide
  misc_feature (34)..(36): n is a, c, g, or t
tgcaggaccagagaattcgaatacaggctcgcannntgcatcaggt

SEQ ID NO: 2165 - DNA, 46 bp, Artificial Sequence
  Synthesized adaptor olignonucleotide
  misc_feature (34)..(36): n is a, c, g, or t
tgcaggaccagagaattcgaatacagtttagtannntgcatcaggt

SEQ ID NO: 2166 - DNA, 46 bp, Artificial Sequence
  Synthesized adaptor olignonucleotide
  misc_feature (34)..(36): n is a, c, g, or t
tgcaggaccagagaattcgaatacactgaaattnnntgcatcaggt

SEQ ID NO: 2167 - DNA, 46 bp, Artificial Sequence
  Synthesized adaptor olignonucleotide
  misc_feature (34)..(36): n is a, c, g, or t
tgcaggaccagagaattcgaatacaaacacctgnnntgcatcaggt

SEQ ID NO: 2168 - DNA, 46 bp, Artificial Sequence
  Synthesized adaptor olignonucleotide
  misc_feature (34)..(36): n is a, c, g, or t
tgcaggaccagagaattcgaatacaggaaaaccnnntgcatcaggt

SEQ ID NO: 2169 - DNA, 46 bp, Artificial Sequence
  Synthesized adaptor olignonucleotide
  misc_feature (34)..(36): n is a, c, g, or t
tgcaggaccagagaattcgaatacagcttctcannnacgtatgcca

SEQ ID NO: 2170 - DNA, 46 bp, Artificial Sequence
  Synthesized adaptor olignonucleotide
  misc_feature (34)..(36): n is a, c, g, or t
tgcaggaccagagaattcgaatacaatgctacgnnnacgtatgcca

SEQ ID NO: 2171 - DNA, 46 bp, Artificial Sequence
  Synthesized adaptor olignonucleotide
  misc_feature (34)..(36): n is a, c, g, or t
tgcaggaccagagaattcgaatacatactctcgnnnacgtatgcca

SEQ ID NO: 2172 - DNA, 46 bp, Artificial Sequence
  Synthesized adaptor olignonucleotide
  misc_feature (34)..(36): n is a, c, g, or t
tgcaggaccagagaattcgaatacacggtcgcannnacgtatgcca

SEQ ID NO: 2173 - DNA, 46 bp, Artificial Sequence
  Synthesized adaptor olignonucleotide
  misc_feature (34)..(36): n is a, c, g, or t
tgcaggaccagagaattcgaatacaacggttacnnnacgtatgcca

SEQ ID NO: 2174 - DNA, 46 bp, Artificial Sequence
  Synthesized adaptor olignonucleotide
  misc_feature (34)..(36): n is a, c, g, or t
tgcaggaccagagaattcgaatacatagcacacnnnacgtatgcca

SEQ ID NO: 2175 - DNA, 46 bp, Artificial Sequence
  Synthesized adaptor olignonucleotide
  misc_feature (34)..(36): n is a, c, g, or t
tgcaggaccagagaattcgaatacacgtctctannnacgtatgcca

SEQ ID NO: 2176 - DNA, 46 bp, Artificial Sequence
  Synthesized adaptor olignonucleotide
  misc_feature (34)..(36): n is a, c, g, or t
tgcaggaccagagaattcgaatacagctccgctnnnacgtatgcca

SEQ ID NO: 2177 - DNA, 46 bp, Artificial Sequence
  Synthesized adaptor olignonucleotide
  misc_feature (34)..(36): n is a, c, g, or t
tgcaggaccagagaattcgaatacagtggcaccnnnacgtatgcca

SEQ ID NO: 2178 - DNA, 46 bp, Artificial Sequence
  Synthesized adaptor olignonucleotide
  misc_feature (34)..(36): n is a, c, g, or t
tgcaggaccagagaattcgaatacagcactatgnnnacgtatgcca

SEQ ID NO: 2179 - DNA, 46 bp, Artificial Sequence
  Synthesized adaptor olignonucleotide
  misc_feature (34)..(36): n is a, c, g, or t
tgcaggaccagagaattcgaatacaaataacgannnacgtatgcca

SEQ ID NO: 2180 - DNA, 46 bp, Artificial Sequence
  Synthesized adaptor olignonucleotide
  misc_feature (34)..(36): n is a, c, g, or t
tgcaggaccagagaattcgaatacaggtataggnnnacgtatgcca

SEQ ID NO: 2181 - DNA, 46 bp, Artificial Sequence
  Synthesized adaptor olignonucleotide
  misc_feature (34)..(36): n is a, c, g, or t
tgcaggaccagagaattcgaatacaagaaccctnnnacgtatgcca

SEQ ID NO: 2182 - DNA, 46 bp, Artificial Sequence
  Synthesized adaptor olignonucleotide
  misc_feature (34)..(36): n is a, c, g, or t
tgcaggaccagagaattcgaatacagccgcgtannnacgtatgcca

SEQ ID NO: 2183 - DNA, 46 bp, Artificial Sequence
  Synthesized adaptor olignonucleotide
  misc_feature (34)..(36): n is a, c, g, or t
tgcaggaccagagaattcgaatacattccctgannnacgtatgcca

SEQ ID NO: 2184 - DNA, 46 bp, Artificial Sequence
  Synthesized adaptor olignonucleotide
  misc_feature (34)..(36): n is a, c, g, or t
tgcaggaccagagaattcgaatacaatggcatcnnnacgtatgcca

SEQ ID NO: 2185 - DNA, 46 bp, Artificial Sequence
  Synthesized adaptor olignonucleotide
  misc_feature (34)..(36): n is a, c, g, or t
tgcaggaccagagaattcgaatacaaaggatcgnnnacgtatgcca

SEQ ID NO: 2186 - DNA, 46 bp, Artificial Sequence
  Synthesized adaptor olignonucleotide
  misc_feature (34)..(36): n is a, c, g, or t
tgcaggaccagagaattcgaatacagtgcatcannnacgtatgcca

SEQ ID NO: 2187 - DNA, 46 bp, Artificial Sequence
  Synthesized adaptor olignonucleotide
  misc_feature (34)..(36): n is a, c, g, or t
tgcaggaccagagaattcgaatacagtcgtcttnnnacgtatgcca

SEQ ID NO: 2188 - DNA, 46 bp, Artificial Sequence
  Synthesized adaptor olignonucleotide
  misc_feature (34)..(36): n is a, c, g, or t
tgcaggaccagagaattcgaatacacttgaggtnnnacgtatgcca

SEQ ID NO: 2189 - DNA, 46 bp, Artificial Sequence
  Synthesized adaptor olignonucleotide
  misc_feature (34)..(36): n is a, c, g, or t
tgcaggaccagagaattcgaatacatacatcaannnacgtatgcca

SEQ ID NO: 2190 - DNA, 46 bp, Artificial Sequence
  Synthesized adaptor olignonucleotide
  misc_feature (34)..(36): n is a, c, g, or t
tgcaggaccagagaattcgaatacaccgaaccgnnnacgtatgcca

SEQ ID NO: 2191 - DNA, 46 bp, Artificial Sequence
  Synthesized adaptor olignonucleotide
  misc_feature (34)..(36): n is a, c, g, or t
tgcaggaccagagaattcgaatacacccacaccnnnacgtatgcca

SEQ ID NO: 2192 - DNA, 46 bp, Artificial Sequence
  Synthesized adaptor olignonucleotide
  misc_feature (34)..(36): n is a, c, g, or t
tgcaggaccagagaattcgaatacaacgtaaaannnacgtatgcca

SEQ ID NO: 2193 - DNA, 46 bp, Artificial Sequence
  Synthesized adaptor olignonucleotide
  misc_feature (34)..(36): n is a, c, g, or t
tgcaggaccagagaattcgaatacagtagagtgnnnacgtatgcca

SEQ ID NO: 2194 - DNA, 46 bp, Artificial Sequence
  Synthesized adaptor olignonucleotide
  misc_feature (34)..(36): n is a, c, g, or t
tgcaggaccagagaattcgaatacaccacatagnnnacgtatgcca

SEQ ID NO: 2195 - DNA, 46 bp, Artificial Sequence
  Synthesized adaptor olignonucleotide
  misc_feature (34)..(36): n is a, c, g, or t
tgcaggaccagagaattcgaatacatctgtgctnnnacgtatgcca

SEQ ID NO: 2196 - DNA, 46 bp, Artificial Sequence
  Synthesized adaptor olignonucleotide
  misc_feature (34)..(36): n is a, c, g, or t
tgcaggaccagagaattcgaatacatagtacatnnnacgtatgcca

SEQ ID NO: 2197 - DNA, 46 bp, Artificial Sequence
  Synthesized adaptor olignonucleotide
  misc_feature (34)..(36): n is a, c, g, or t
tgcaggaccagagaattcgaatacaccggacacnnnacgtatgcca

SEQ ID NO: 2198 - DNA, 46 bp, Artificial Sequence
  Synthesized adaptor olignonucleotide
  misc_feature (34)..(36): n is a, c, g, or t
tgcaggaccagagaattcgaatacagtaagctcnnnacgtatgcca

SEQ ID NO: 2199 - DNA, 46 bp, Artificial Sequence
  Synthesized adaptor olignonucleotide
  misc_feature (34)..(36): n is a, c, g, or t
tgcaggaccagagaattcgaatacaacttggtgnnnacgtatgcca

SEQ ID NO: 2200 - DNA, 46 bp, Artificial Sequence
  Synthesized adaptor olignonucleotide
  misc_feature (34)..(36): n is a, c, g, or t
tgcaggaccagagaattcgaatacacgacctggnnnacgtatgcca

SEQ ID NO: 2201 - DNA, 46 bp, Artificial Sequence
  Synthesized adaptor olignonucleotide
  misc_feature (34)..(36): n is a, c, g, or t
tgcaggaccagagaattcgaatacatgaggatgnnnacgtatgcca

SEQ ID NO: 2202 - DNA, 46 bp, Artificial Sequence
  Synthesized adaptor olignonucleotide
  misc_feature (34)..(36): n is a, c, g, or t
tgcaggaccagagaattcgaatacactcgtgccnnnacgtatgcca

SEQ ID NO: 2203 - DNA, 46 bp, Artificial Sequence
  Synthesized adaptor olignonucleotide
  misc_feature (34)..(36): n is a, c, g, or t
tgcaggaccagagaattcgaatacattgctcgtnnnacgtatgcca

SEQ ID NO: 2204 - DNA, 46 bp, Artificial Sequence
  Synthesized adaptor olignonucleotide
  misc_feature (34)..(36): n is a, c, g, or t
tgcaggaccagagaattcgaatacaacactgacnnnacgtatgcca

SEQ ID NO: 2205 - DNA, 46 bp, Artificial Sequence
  Synthesized adaptor olignonucleotide
  misc_feature (34)..(36): n is a, c, g, or t
tgcaggaccagagaattcgaatacagttggtacnnnacgtatgcca

SEQ ID NO: 2206 - DNA, 46 bp, Artificial Sequence
  Synthesized adaptor olignonucleotide
  misc_feature (34)..(36): n is a, c, g, or t
tgcaggaccagagaattcgaatacattcagtccnnnacgtatgcca

SEQ ID NO: 2207 - DNA, 46 bp, Artificial Sequence
  Synthesized adaptor olignonucleotide
  misc_feature (34)..(36): n is a, c, g, or t
tgcaggaccagagaattcgaatacagtaacaaannnacgtatgcca

SEQ ID NO: 2208 - DNA, 46 bp, Artificial Sequence
  Synthesized adaptor olignonucleotide
  misc_feature (34)..(36): n is a, c, g, or t
tgcaggaccagagaattcgaatacacaactggtnnnacgtatgcca

SEQ ID NO: 2209 - DNA, 46 bp, Artificial Sequence
  Synthesized adaptor olignonucleotide
  misc_feature (34)..(36): n is a, c, g, or t
tgcaggaccagagaattcgaatacatggataccnnnacgtatgcca

SEQ ID NO: 2210 - DNA, 46 bp, Artificial Sequence
  Synthesized adaptor olignonucleotide
  misc_feature (34)..(36): n is a, c, g, or t
tgcaggaccagagaattcgaatacaatgcaccannnacgtatgcca

SEQ ID NO: 2211 - DNA, 46 bp, Artificial Sequence
  Synthesized adaptor olignonucleotide
  misc_feature (34)..(36): n is a, c, g, or t
tgcaggaccagagaattcgaatacaactccttgnnnacgtatgcca

SEQ ID NO: 2212 - DNA, 46 bp, Artificial Sequence
  Synthesized adaptor olignonucleotide
  misc_feature (34)..(36): n is a, c, g, or t
tgcaggaccagagaattcgaatacaaatagttcnnnacgtatgcca

SEQ ID NO: 2213 - DNA, 46 bp, Artificial Sequence
  Synthesized adaptor olignonucleotide
  misc_feature (34)..(36): n is a, c, g, or t
tgcaggaccagagaattcgaatacatgagagcannnacgtatgcca

SEQ ID NO: 2214 - DNA, 46 bp, Artificial Sequence
  Synthesized adaptor olignonucleotide
  misc_feature (34)..(36): n is a, c, g, or t
tgcaggaccagagaattcgaatacatcaccccgnnnacgtatgcca

SEQ ID NO: 2215 - DNA, 46 bp, Artificial Sequence
  Synthesized adaptor olignonucleotide
  misc_feature (34)..(36): n is a, c, g, or t
tgcaggaccagagaattcgaatacataatggaannnacgtatgcca

SEQ ID NO: 2216 - DNA, 46 bp, Artificial Sequence
  Synthesized adaptor olignonucleotide
  misc_feature (34)..(36): n is a, c, g, or t
tgcaggaccagagaattcgaatacatccaaatannnacgtatgcca

SEQ ID NO: 2217 - DNA, 46 bp, Artificial Sequence
  Synthesized adaptor olignonucleotide
  misc_feature (34)..(36): n is a, c, g, or t
tgcaggaccagagaattcgaatacagaggctccnnnacgtatgcca

SEQ ID NO: 2218 - DNA, 46 bp, Artificial Sequence
  Synthesized adaptor olignonucleotide
  misc_feature (34)..(36): n is a, c, g, or t
tgcaggaccagagaattcgaatacatccgcgtcnnnacgtatgcca

SEQ ID NO: 2219 - DNA, 46 bp, Artificial Sequence
  Synthesized adaptor olignonucleotide
  misc_feature (34)..(36): n is a, c, g, or t
tgcaggaccagagaattcgaatacagcattgcannnacgtatgcca

SEQ ID NO: 2220 - DNA, 46 bp, Artificial Sequence
  Synthesized adaptor olignonucleotide
  misc_feature (34)..(36): n is a, c, g, or t
tgcaggaccagagaattcgaatacaccccttaannnacgtatgcca

SEQ ID NO: 2221 - DNA, 46 bp, Artificial Sequence
  Synthesized adaptor olignonucleotide
  misc_feature (34)..(36): n is a, c, g, or t
tgcaggaccagagaattcgaatacagaccgccannnacgtatgcca

SEQ ID NO: 2222 - DNA, 46 bp, Artificial Sequence
  Synthesized adaptor olignonucleotide
  misc_feature (34)..(36): n is a, c, g, or t
tgcaggaccagagaattcgaatacagatctgacnnnacgtatgcca

SEQ ID NO: 2223 - DNA, 46 bp, Artificial Sequence
  Synthesized adaptor olignonucleotide
  misc_feature (34)..(36): n is a, c, g, or t
tgcaggaccagagaattcgaatacagcatgttgnnnacgtatgcca

SEQ ID NO: 2224 - DNA, 46 bp, Artificial Sequence
  Synthesized adaptor olignonucleotide
  misc_feature (34)..(36): n is a, c, g, or t
tgcaggaccagagaattcgaatacatagcacgtnnnacgtatgcca

SEQ ID NO: 2225 - DNA, 46 bp, Artificial Sequence
  Synthesized adaptor olignonucleotide
  misc_feature (34)..(36): n is a, c, g, or t
tgcaggaccagagaattcgaatacaggtccaatnnnacgtatgcca

SEQ ID NO: 2226 - DNA, 46 bp, Artificial Sequence
  Synthesized adaptor olignonucleotide
  misc_feature (34)..(36): n is a, c, g, or t
tgcaggaccagagaattcgaatacaaccctctannnacgtatgcca

SEQ ID NO: 2227 - DNA, 46 bp, Artificial Sequence
  Synthesized adaptor olignonucleotide
  misc_feature (34)..(36): n is a, c, g, or t
tgcaggaccagagaattcgaatacattacgacgnnnacgtatgcca

SEQ ID NO: 2228 - DNA, 46 bp, Artificial Sequence
  Synthesized adaptor olignonucleotide
  misc_feature (34)..(36): n is a, c, g, or t
tgcaggaccagagaattcgaatacacatatcggnnnacgtatgcca

SEQ ID NO: 2229 - DNA, 46 bp, Artificial Sequence
  Synthesized adaptor olignonucleotide
  misc_feature (34)..(36): n is a, c, g, or t
tgcaggaccagagaattcgaatacagcgatatcnnnctagcgttac

SEQ ID NO: 2230 - DNA, 46 bp, Artificial Sequence
  Synthesized adaptor olignonucleotide
  misc_feature (34)..(36): n is a, c, g, or t
tgcaggaccagagaattcgaatacatacgaggannnctagcgttac

SEQ ID NO: 2231 - DNA, 46 bp, Artificial Sequence
  Synthesized adaptor olignonucleotide
  misc_feature (34)..(36): n is a, c, g, or t
tgcaggaccagagaattcgaatacatcttacatnnnctagcgttac

SEQ ID NO: 2232 - DNA, 46 bp, Artificial Sequence
  Synthesized adaptor olignonucleotide
  misc_feature (34)..(36): n is a, c, g, or t
tgcaggaccagagaattcgaatacagcgtctccnnnctagcgttac

SEQ ID NO: 2233 - DNA, 46 bp, Artificial Sequence
  Synthesized adaptor olignonucleotide
  misc_feature (34)..(36): n is a, c, g, or t
tgcaggaccagagaattcgaatacataatccggnnnctagcgttac

SEQ ID NO: 2234 - DNA, 46 bp, Artificial Sequence
  Synthesized adaptor olignonucleotide
  misc_feature (34)..(36): n is a, c, g, or t
tgcaggaccagagaattcgaatacacagcatacnnnctagcgttac

SEQ ID NO: 2235 - DNA, 46 bp, Artificial Sequence
  Synthesized adaptor olignonucleotide
  misc_feature (34)..(36): n is a, c, g, or t
tgcaggaccagagaattcgaatacagttctccannnctagcgttac

SEQ ID NO: 2236 - DNA, 46 bp, Artificial Sequence
  Synthesized adaptor olignonucleotide
  misc_feature (34)..(36): n is a, c, g, or t
tgcaggaccagagaattcgaatacaagttcctcnnnctagcgttac

SEQ ID NO: 2237 - DNA, 46 bp, Artificial Sequence
  Synthesized adaptor olignonucleotide
  misc_feature (34)..(36): n is a, c, g, or t
tgcaggaccagagaattcgaatacaaaatcgaannnctagcgttac

SEQ ID NO: 2238 - DNA, 46 bp, Artificial Sequence
  Synthesized adaptor olignonucleotide
  misc_feature (34)..(36): n is a, c, g, or t
tgcaggaccagagaattcgaatacaagattatcnnnctagcgttac

SEQ ID NO: 2239 - DNA, 46 bp, Artificial Sequence
  Synthesized adaptor olignonucleotide
  misc_feature (34)..(36): n is a, c, g, or t
tgcaggaccagagaattcgaatacagtttcaccnnnctagcgttac

SEQ ID NO: 2240 - DNA, 46 bp, Artificial Sequence
  Synthesized adaptor olignonucleotide
  misc_feature (34)..(36): n is a, c, g, or t
tgcaggaccagagaattcgaatacaattacatgnnnctagcgttac

SEQ ID NO: 2241 - DNA, 46 bp, Artificial Sequence
  Synthesized adaptor olignonucleotide
  misc_feature (34)..(36): n is a, c, g, or t
tgcaggaccagagaattcgaatacaaccatcctnnnctagcgttac

SEQ ID NO: 2242 - DNA, 46 bp, Artificial Sequence
  Synthesized adaptor olignonucleotide
  misc_feature (34)..(36): n is a, c, g, or t
tgcaggaccagagaattcgaatacacagactacnnnctagcgttac

SEQ ID NO: 2243 - DNA, 46 bp, Artificial Sequence
  Synthesized adaptor olignonucleotide
  misc_feature (34)..(36): n is a, c, g, or t
tgcaggaccagagaattcgaatacacattggtgnnnctagcgttac

SEQ ID NO: 2244 - DNA, 46 bp, Artificial Sequence
  Synthesized adaptor olignonucleotide
  misc_feature (34)..(36): n is a, c, g, or t
tgcaggaccagagaattcgaatacagagaccttnnnctagcgttac

SEQ ID NO: 2245 - DNA, 46 bp, Artificial Sequence
  Synthesized adaptor olignonucleotide
  misc_feature (34)..(36): n is a, c, g, or t
tgcaggaccagagaattcgaatacatcaggccgnnnctagcgttac

SEQ ID NO: 2246 - DNA, 46 bp, Artificial Sequence
  Synthesized adaptor olignonucleotide
  misc_feature (34)..(36): n is a, c, g, or t
tgcaggaccagagaattcgaatacacaacacacnnnctagcgttac

SEQ ID NO: 2247 - DNA, 46 bp, Artificial Sequence
  Synthesized adaptor olignonucleotide
  misc_feature (34)..(36): n is a, c, g, or t
tgcaggaccagagaattcgaatacacgacgtcgnnnctagcgttac

SEQ ID NO: 2248 - DNA, 46 bp, Artificial Sequence
  Synthesized adaptor olignonucleotide
  misc_feature (34)..(36): n is a, c, g, or t
tgcaggaccagagaattcgaatacatagactatnnnctagcgttac

SEQ ID NO: 2249 - DNA, 46 bp, Artificial Sequence
  Synthesized adaptor olignonucleotide
  misc_feature (34)..(36): n is a, c, g, or t
tgcaggaccagagaattcgaatacaccgagaaannnctagcgttac

SEQ ID NO: 2250 - DNA, 46 bp, Artificial Sequence
  Synthesized adaptor olignonucleotide
  misc_feature (34)..(36): n is a, c, g, or t
tgcaggaccagagaattcgaatacattccatatnnnctagcgttac

SEQ ID NO: 2251 - DNA, 46 bp, Artificial Sequence
  Synthesized adaptor olignonucleotide
  misc_feature (34)..(36): n is a, c, g, or t
tgcaggaccagagaattcgaatacagccatgatnnnctagcgttac

SEQ ID NO: 2252 - DNA, 46 bp, Artificial Sequence
  Synthesized adaptor olignonucleotide
  misc_feature (34)..(36): n is a, c, g, or t
tgcaggaccagagaattcgaatacaggcgacgannnctagcgttac

SEQ ID NO: 2253 - DNA, 46 bp, Artificial Sequence
  Synthesized adaptor olignonucleotide
  misc_feature (34)..(36): n is a, c, g, or t
tgcaggaccagagaattcgaatacacccagtaannnctagcgttac

SEQ ID NO: 2254 - DNA, 46 bp, Artificial Sequence
  Synthesized adaptor olignonucleotide
  misc_feature (34)..(36): n is a, c, g, or t
tgcaggaccagagaattcgaatacactcaaacgnnnctagcgttac

SEQ ID NO: 2255 - DNA, 46 bp, Artificial Sequence
  Synthesized adaptor olignonucleotide
  misc_feature (34)..(36): n is a, c, g, or t
tgcaggaccagagaattcgaatacacagatctgnnnctagcgttac

SEQ ID NO: 2256 - DNA, 46 bp, Artificial Sequence
  Synthesized adaptor olignonucleotide
  misc_feature (34)..(36): n is a, c, g, or t
tgcaggaccagagaattcgaatacaagaaaatcnnnctagcgttac

SEQ ID NO: 2257 - DNA, 46 bp, Artificial Sequence
  Synthesized adaptor olignonucleotide
  misc_feature (34)..(36): n is a, c, g, or t
tgcaggaccagagaattcgaatacaatctttcannnctagcgttac

SEQ ID NO: 2258 - DNA, 46 bp, Artificial Sequence
  Synthesized adaptor olignonucleotide
  misc_feature (34)..(36): n is a, c, g, or t
tgcaggaccagagaattcgaatacacccatctannnctagcgttac

SEQ ID NO: 2259 - DNA, 46 bp, Artificial Sequence
  Synthesized adaptor olignonucleotide
  misc_feature (34)..(36): n is a, c, g, or t
tgcaggaccagagaattcgaatacactaaggtcnnnctagcgttac

SEQ ID NO: 2260 - DNA, 46 bp, Artificial Sequence
  Synthesized adaptor olignonucleotide
  misc_feature (34)..(36): n is a, c, g, or t
tgcaggaccagagaattcgaatacacaccgacgnnnctagcgttac

SEQ ID NO: 2261 - DNA, 46 bp, Artificial Sequence
  Synthesized adaptor olignonucleotide
  misc_feature (34)..(36): n is a, c, g, or t
tgcaggaccagagaattcgaatacagtttagatnnnctagcgttac

SEQ ID NO: 2262 - DNA, 46 bp, Artificial Sequence
  Synthesized adaptor olignonucleotide
  misc_feature (34)..(36): n is a, c, g, or t
tgcaggaccagagaattcgaatacatcccctccnnnctagcgttac

SEQ ID NO: 2263 - DNA, 46 bp, Artificial Sequence
  Synthesized adaptor olignonucleotide
  misc_feature (34)..(36): n is a, c, g, or t
tgcaggaccagagaattcgaatacattaatcagnnnctagcgttac

SEQ ID NO: 2264 - DNA, 46 bp, Artificial Sequence
  Synthesized adaptor olignonucleotide
  misc_feature (34)..(36): n is a, c, g, or t
tgcaggaccagagaattcgaatacacattcgagnnnctagcgttac

SEQ ID NO: 2265 - DNA, 46 bp, Artificial Sequence
  Synthesized adaptor olignonucleotide
  misc_feature (34)..(36): n is a, c, g, or t
tgcaggaccagagaattcgaatacaaaccgtgtnnnctagcgttac

SEQ ID NO: 2266 - DNA, 46 bp, Artificial Sequence
  Synthesized adaptor olignonucleotide
  misc_feature (34)..(36): n is a, c, g, or t
tgcaggaccagagaattcgaatacacccaattcnnnctagcgttac

SEQ ID NO: 2267 - DNA, 46 bp, Artificial Sequence
  Synthesized adaptor olignonucleotide
  misc_feature (34)..(36): n is a, c, g, or t
tgcaggaccagagaattcgaatacattggtggtnnnctagcgttac

SEQ ID NO: 2268 - DNA, 46 bp, Artificial Sequence
  Synthesized adaptor olignonucleotide
  misc_feature (34)..(36): n is a, c, g, or t
tgcaggaccagagaattcgaatacatgcttaggnnnctagcgttac

SEQ ID NO: 2269 - DNA, 46 bp, Artificial Sequence
  Synthesized adaptor olignonucleotide
  misc_feature (34)..(36): n is a, c, g, or t
tgcaggaccagagaattcgaatacaacacccccnnnctagcgttac

SEQ ID NO: 2270 - DNA, 46 bp, Artificial Sequence
  Synthesized adaptor olignonucleotide
  misc_feature (34)..(36): n is a, c, g, or t
tgcaggaccagagaattcgaatacaccattgagnnnctagcgttac

SEQ ID NO: 2271 - DNA, 46 bp, Artificial Sequence
  Synthesized adaptor olignonucleotide
  misc_feature (34)..(36): n is a, c, g, or t
tgcaggaccagagaattcgaatacaacttaaacnnnctagcgttac

SEQ ID NO: 2272 - DNA, 46 bp, Artificial Sequence
  Synthesized adaptor olignonucleotide
  misc_feature (34)..(36): n is a, c, g, or t
tgcaggaccagagaattcgaatacatatagtacnnnctagcgttac

SEQ ID NO: 2273 - DNA, 46 bp, Artificial Sequence
  Synthesized adaptor olignonucleotide
  misc_feature (34)..(36): n is a, c, g, or t
tgcaggaccagagaattcgaatacacagtgtacnnnctagcgttac

SEQ ID NO: 2274 - DNA, 46 bp, Artificial Sequence
  Synthesized adaptor olignonucleotide
  misc_feature (34)..(36): n is a, c, g, or t
tgcaggaccagagaattcgaatacagcgtctttnnnctagcgttac

SEQ ID NO: 2275 - DNA, 46 bp, Artificial Sequence
  Synthesized adaptor olignonucleotide
  misc_feature (34)..(36): n is a, c, g, or t
tgcaggaccagagaattcgaatacatgactcagnnnctagcgttac

SEQ ID NO: 2276 - DNA, 46 bp, Artificial Sequence
  Synthesized adaptor olignonucleotide
  misc_feature (34)..(36): n is a, c, g, or t
tgcaggaccagagaattcgaatacaacttagtannnctagcgttac

SEQ ID NO: 2277 - DNA, 46 bp, Artificial Sequence
  Synthesized adaptor olignonucleotide
  misc_feature (34)..(36): n is a, c, g, or t
tgcaggaccagagaattcgaatacaaaacatgannnctagcgttac

SEQ ID NO: 2278 - DNA, 46 bp, Artificial Sequence
  Synthesized adaptor olignonucleotide
  misc_feature (34)..(36): n is a, c, g, or t
tgcaggaccagagaattcgaatacagttaggctnnnctagcgttac

SEQ ID NO: 2279 - DNA, 46 bp, Artificial Sequence
  Synthesized adaptor olignonucleotide
  misc_feature (34)..(36): n is a, c, g, or t
tgcaggaccagagaattcgaatacatccgcaggnnnctagcgttac

SEQ ID NO: 2280 - DNA, 46 bp, Artificial Sequence
  Synthesized adaptor olignonucleotide
  misc_feature (34)..(36): n is a, c, g, or t
tgcaggaccagagaattcgaatacaagtacattnnnctagcgttac

SEQ ID NO: 2281 - DNA, 46 bp, Artificial Sequence
  Synthesized adaptor olignonucleotide
  misc_feature (34)..(36): n is a, c, g, or t
tgcaggaccagagaattcgaatacaggtcgtatnnnctagcgttac

SEQ ID NO: 2282 - DNA, 46 bp, Artificial Sequence
  Synthesized adaptor olignonucleotide
  misc_feature (34)..(36): n is a, c, g, or t
tgcaggaccagagaattcgaatacaagacgacannnctagcgttac

SEQ ID NO: 2283 - DNA, 46 bp, Artificial Sequence
  Synthesized adaptor olignonucleotide
  misc_feature (34)..(36): n is a, c, g, or t
tgcaggaccagagaattcgaatacaaagttctannnctagcgttac

SEQ ID NO: 2284 - DNA, 46 bp, Artificial Sequence
  Synthesized adaptor olignonucleotide
  misc_feature (34)..(36): n is a, c, g, or t
tgcaggaccagagaattcgaatacaaccgaactnnnctagcgttac

SEQ ID NO: 2285 - DNA, 46 bp, Artificial Sequence
  Synthesized adaptor olignonucleotide
  misc_feature (34)..(36): n is a, c, g, or t
tgcaggaccagagaattcgaatacaggcaattcnnnctagcgttac

SEQ ID NO: 2286 - DNA, 46 bp, Artificial Sequence
  Synthesized adaptor olignonucleotide
  misc_feature (34)..(36): n is a, c, g, or t
tgcaggaccagagaattcgaatacagtcacacannnctagcgttac

SEQ ID NO: 2287 - DNA, 46 bp, Artificial Sequence
  Synthesized adaptor olignonucleotide
  misc_feature (34)..(36): n is a, c, g, or t
tgcaggaccagagaattcgaatacacggaaatgnnnctagcgttac

SEQ ID NO: 2288 - DNA, 46 bp, Artificial Sequence
  Synthesized adaptor olignonucleotide
  misc_feature (34)..(36): n is a, c, g, or t
tgcaggaccagagaattcgaatacactgtctacnnnctagcgttac

SEQ ID NO: 2289 - DNA, 46 bp, Artificial Sequence
  Synthesized adaptor olignonucleotide
  misc_feature (34)..(36): n is a, c, g, or t
tgcaggaccagagaattcgaatacagagccaggnnngatcgacatg

SEQ ID NO: 2290 - DNA, 46 bp, Artificial Sequence
  Synthesized adaptor olignonucleotide
  misc_feature (34)..(36): n is a, c, g, or t
tgcaggaccagagaattcgaatacacactcctannngatcgacatg

SEQ ID NO: 2291 - DNA, 46 bp, Artificial Sequence
  Synthesized adaptor olignonucleotide
  misc_feature (34)..(36): n is a, c, g, or t
tgcaggaccagagaattcgaatacactttccctnnngatcgacatg

SEQ ID NO: 2292 - DNA, 46 bp, Artificial Sequence
  Synthesized adaptor olignonucleotide
  misc_feature (34)..(36): n is a, c, g, or t
tgcaggaccagagaattcgaatacactgagctannngatcgacatg

SEQ ID NO: 2293 - DNA, 46 bp, Artificial Sequence
  Synthesized adaptor olignonucleotide
  misc_feature (34)..(36): n is a, c, g, or t
tgcaggaccagagaattcgaatacagtctgacannngatcgacatg

SEQ ID NO: 2294 - DNA, 46 bp, Artificial Sequence
  Synthesized adaptor olignonucleotide
  misc_feature (34)..(36): n is a, c, g, or t
tgcaggaccagagaattcgaatacactgacgcgnnngatcgacatg

SEQ ID NO: 2295 - DNA, 46 bp, Artificial Sequence
  Synthesized adaptor olignonucleotide
  misc_feature (34)..(36): n is a, c, g, or t
tgcaggaccagagaattcgaatacagtgatggannngatcgacatg

SEQ ID NO: 2296 - DNA, 46 bp, Artificial Sequence
  Synthesized adaptor olignonucleotide
  misc_feature (34)..(36): n is a, c, g, or t
tgcaggaccagagaattcgaatacagaattctannngatcgacatg

SEQ ID NO: 2297 - DNA, 46 bp, Artificial Sequence
  Synthesized adaptor olignonucleotide
  misc_feature (34)..(36): n is a, c, g, or t
tgcaggaccagagaattcgaatacacgtgcatannngatcgacatg

SEQ ID NO: 2298 - DNA, 46 bp, Artificial Sequence
  Synthesized adaptor olignonucleotide
  misc_feature (34)..(36): n is a, c, g, or t
tgcaggaccagagaattcgaatacatggcgtgcnnngatcgacatg

SEQ ID NO: 2299 - DNA, 46 bp, Artificial Sequence
  Synthesized adaptor olignonucleotide
  misc_feature (34)..(36): n is a, c, g, or t
tgcaggaccagagaattcgaatacaccagtgcgnnngatcgacatg

SEQ ID NO: 2300 - DNA, 46 bp, Artificial Sequence
  Synthesized adaptor olignonucleotide
  misc_feature (34)..(36): n is a, c, g, or t
tgcaggaccagagaattcgaatacatgcccctgnnngatcgacatg

SEQ ID NO: 2301 - DNA, 46 bp, Artificial Sequence
  Synthesized adaptor olignonucleotide
  misc_feature (34)..(36): n is a, c, g, or t
tgcaggaccagagaattcgaatacatccgtcgcnnngatcgacatg

SEQ ID NO: 2302 - DNA, 46 bp, Artificial Sequence
  Synthesized adaptor olignonucleotide
  misc_feature (34)..(36): n is a, c, g, or t
tgcaggaccagagaattcgaatacagtcctccgnnngatcgacatg

SEQ ID NO: 2303 - DNA, 46 bp, Artificial Sequence
  Synthesized adaptor olignonucleotide
  misc_feature (34)..(36): n is a, c, g, or t
tgcaggaccagagaattcgaatacagctccattnnngatcgacatg

SEQ ID NO: 2304 - DNA, 46 bp, Artificial Sequence
  Synthesized adaptor olignonucleotide
  misc_feature (34)..(36): n is a, c, g, or t
tgcaggaccagagaattcgaatacagactccttnnngatcgacatg

SEQ ID NO: 2305 - DNA, 46 bp, Artificial Sequence
  Synthesized adaptor olignonucleotide
  misc_feature (34)..(36): n is a, c, g, or t
tgcaggaccagagaattcgaatacatgtaactannngatcgacatg

SEQ ID NO: 2306 - DNA, 46 bp, Artificial Sequence
  Synthesized adaptor olignonucleotide
  misc_feature (34)..(36): n is a, c, g, or t
tgcaggaccagagaattcgaatacaagagtctcnnngatcgacatg

SEQ ID NO: 2307 - DNA, 46 bp, Artificial Sequence
  Synthesized adaptor olignonucleotide
  misc_feature (34)..(36): n is a, c, g, or t
tgcaggaccagagaattcgaatacactttctaannngatcgacatg

SEQ ID NO: 2308 - DNA, 46 bp, Artificial Sequence
  Synthesized adaptor olignonucleotide
  misc_feature (34)..(36): n is a, c, g, or t
tgcaggaccagagaattcgaatacacgagacccnnngatcgacatg

SEQ ID NO: 2309 - DNA, 46 bp, Artificial Sequence
  Synthesized adaptor olignonucleotide
  misc_feature (34)..(36): n is a, c, g, or t
tgcaggaccagagaattcgaatacattttagtcnnngatcgacatg

SEQ ID NO: 2310 - DNA, 46 bp, Artificial Sequence
  Synthesized adaptor olignonucleotide
  misc_feature (34)..(36): n is a, c, g, or t
tgcaggaccagagaattcgaatacaatgtgctgnnngatcgacatg

SEQ ID NO: 2311 - DNA, 46 bp, Artificial Sequence
  Synthesized adaptor olignonucleotide
  misc_feature (34)..(36): n is a, c, g, or t
tgcaggaccagagaattcgaatacacccaggtgnnngatcgacatg

SEQ ID NO: 2312 - DNA, 46 bp, Artificial Sequence
  Synthesized adaptor olignonucleotide
  misc_feature (34)..(36): n is a, c, g, or t
tgcaggaccagagaattcgaatacagaaccaagnnngatcgacatg

SEQ ID NO: 2313 - DNA, 46 bp, Artificial Sequence
  Synthesized adaptor olignonucleotide
  misc_feature (34)..(36): n is a, c, g, or t
tgcaggaccagagaattcgaatacacctgaggcnnngatcgacatg

SEQ ID NO: 2314 - DNA, 46 bp, Artificial Sequence
  Synthesized adaptor olignonucleotide
  misc_feature (34)..(36): n is a, c, g, or t
tgcaggaccagagaattcgaatacaataagcggnnngatcgacatg

SEQ ID NO: 2315 - DNA, 46 bp, Artificial Sequence
  Synthesized adaptor olignonucleotide
  misc_feature (34)..(36): n is a, c, g, or t
tgcaggaccagagaattcgaatacatttgtcatnnngatcgacatg

SEQ ID NO: 2316 - DNA, 46 bp, Artificial Sequence
  Synthesized adaptor olignonucleotide
  misc_feature (34)..(36): n is a, c, g, or t
tgcaggaccagagaattcgaatacaagcgtttgnnngatcgacatg

SEQ ID NO: 2317 - DNA, 46 bp, Artificial Sequence
  Synthesized adaptor olignonucleotide
  misc_feature (34)..(36): n is a, c, g, or t
tgcaggaccagagaattcgaatacagctattttnnngatcgacatg

SEQ ID NO: 2318 - DNA, 46 bp, Artificial Sequence
  Synthesized adaptor olignonucleotide
  misc_feature (34)..(36): n is a, c, g, or t
tgcaggaccagagaattcgaatacatgacaccannngatcgacatg

SEQ ID NO: 2319 - DNA, 46 bp, Artificial Sequence
  Synthesized adaptor olignonucleotide
  misc_feature (34)..(36): n is a, c, g, or t
tgcaggaccagagaattcgaatacacgctcaaannngatcgacatg

SEQ ID NO: 2320 - DNA, 46 bp, Artificial Sequence
  Synthesized adaptor olignonucleotide
  misc_feature (34)..(36): n is a, c, g, or t
tgcaggaccagagaattcgaatacagcgcattannngatcgacatg

SEQ ID NO: 2321 - DNA, 46 bp, Artificial Sequence
  Synthesized adaptor olignonucleotide
  misc_feature (34)..(36): n is a, c, g, or t
tgcaggaccagagaattcgaatacatctaaatgnnngatcgacatg

SEQ ID NO: 2322 - DNA, 46 bp, Artificial Sequence
  Synthesized adaptor olignonucleotide
  misc_feature (34)..(36): n is a, c, g, or t
tgcaggaccagagaattcgaatacaagcactacnnngatcgacatg

SEQ ID NO: 2323 - DNA, 46 bp, Artificial Sequence
  Synthesized adaptor olignonucleotide
  misc_feature (34)..(36): n is a, c, g, or t
tgcaggaccagagaattcgaatacagattcagcnnngatcgacatg

SEQ ID NO: 2324 - DNA, 46 bp, Artificial Sequence
  Synthesized adaptor olignonucleotide
  misc_feature (34)..(36): n is a, c, g, or t
tgcaggaccagagaattcgaatacactgctccgnnngatcgacatg

SEQ ID NO: 2325 - DNA, 46 bp, Artificial Sequence
  Synthesized adaptor olignonucleotide
  misc_feature (34)..(36): n is a, c, g, or t
tgcaggaccagagaattcgaatacagcacgattnnngatcgacatg

SEQ ID NO: 2326 - DNA, 46 bp, Artificial Sequence
  Synthesized adaptor olignonucleotide
  misc_feature (34)..(36): n is a, c, g, or t
tgcaggaccagagaattcgaatacaatgtcatannngatcgacatg

SEQ ID NO: 2327 - DNA, 46 bp, Artificial Sequence
  Synthesized adaptor olignonucleotide
  misc_feature (34)..(36): n is a, c, g, or t
tgcaggaccagagaattcgaatacaacaggacannngatcgacatg

SEQ ID NO: 2328 - DNA, 46 bp, Artificial Sequence
  Synthesized adaptor olignonucleotide
  misc_feature (34)..(36): n is a, c, g, or t
tgcaggaccagagaattcgaatacaccgtaagtnnngatcgacatg

SEQ ID NO: 2329 - DNA, 46 bp, Artificial Sequence
  Synthesized adaptor olignonucleotide
  misc_feature (34)..(36): n is a, c, g, or t
tgcaggaccagagaattcgaatacaaaagaatcnnngatcgacatg

SEQ ID NO: 2330 - DNA, 46 bp, Artificial Sequence
  Synthesized adaptor olignonucleotide
  misc_feature (34)..(36): n is a, c, g, or t
tgcaggaccagagaattcgaatacacaagcctannngatcgacatg

SEQ ID NO: 2331 - DNA, 46 bp, Artificial Sequence
  Synthesized adaptor olignonucleotide
  misc_feature (34)..(36): n is a, c, g, or t
tgcaggaccagagaattcgaatacactaactaannngatcgacatg

SEQ ID NO: 2332 - DNA, 46 bp, Artificial Sequence
  Synthesized adaptor olignonucleotide
  misc_feature (34)..(36): n is a, c, g, or t
tgcaggaccagagaattcgaatacacgcgtaatnnngatcgacatg

SEQ ID NO: 2333 - DNA, 46 bp, Artificial Sequence
  Synthesized adaptor olignonucleotide
  misc_feature (34)..(36): n is a, c, g, or t
tgcaggaccagagaattcgaatacagaggtcttnnngatcgacatg

SEQ ID NO: 2334 - DNA, 46 bp, Artificial Sequence
  Synthesized adaptor olignonucleotide
  misc_feature (34)..(36): n is a, c, g, or t
tgcaggaccagagaattcgaatacaagccgctgnnngatcgacatg

SEQ ID NO: 2335 - DNA, 46 bp, Artificial Sequence
  Synthesized adaptor olignonucleotide
  misc_feature (34)..(36): n is a, c, g, or t
tgcaggaccagagaattcgaatacagctcaacannngatcgacatg

SEQ ID NO: 2336 - DNA, 46 bp, Artificial Sequence
  Synthesized adaptor olignonucleotide
  misc_feature (34)..(36): n is a, c, g, or t
tgcaggaccagagaattcgaatacaatcaggagnnngatcgacatg

SEQ ID NO: 2337 - DNA, 46 bp, Artificial Sequence
  Synthesized adaptor olignonucleotide
  misc_feature (34)..(36): n is a, c, g, or t
tgcaggaccagagaattcgaatacaccccagagnnngatcgacatg

SEQ ID NO: 2338 - DNA, 46 bp, Artificial Sequence
  Synthesized adaptor olignonucleotide
  misc_feature (34)..(36): n is a, c, g, or t
tgcaggaccagagaattcgaatacagaggtggcnnngatcgacatg

SEQ ID NO: 2339 - DNA, 46 bp, Artificial Sequence
  Synthesized adaptor olignonucleotide
  misc_feature (34)..(36): n is a, c, g, or t
tgcaggaccagagaattcgaatacagccaagccnnngatcgacatg

SEQ ID NO: 2340 - DNA, 46 bp, Artificial Sequence
  Synthesized adaptor olignonucleotide
  misc_feature (34)..(36): n is a, c, g, or t
tgcaggaccagagaattcgaatacactggtggcnnngatcgacatg

SEQ ID NO: 2341 - DNA, 46 bp, Artificial Sequence
  Synthesized adaptor olignonucleotide
  misc_feature (34)..(36): n is a, c, g, or t
tgcaggaccagagaattcgaatacacgtatgtgnnngatcgacatg

SEQ ID NO: 2342 - DNA, 46 bp, Artificial Sequence
  Synthesized adaptor olignonucleotide
  misc_feature (34)..(36): n is a, c, g, or t
tgcaggaccagagaattcgaatacatgcgtttcnnngatcgacatg

SEQ ID NO: 2343 - DNA, 46 bp, Artificial Sequence
  Synthesized adaptor olignonucleotide
  misc_feature (34)..(36): n is a, c, g, or t
tgcaggaccagagaattcgaatacataaatttannngatcgacatg

SEQ ID NO: 2344 - DNA, 46 bp, Artificial Sequence
  Synthesized adaptor olignonucleotide
  misc_feature (34)..(36): n is a, c, g, or t
tgcaggaccagagaattcgaatacatcggacatnnngatcgacatg

SEQ ID NO: 2345 - DNA, 46 bp, Artificial Sequence
  Synthesized adaptor olignonucleotide
  misc_feature (34)..(36): n is a, c, g, or t
tgcaggaccagagaattcgaatacataaacactnnngatcgacatg

SEQ ID NO: 2346 - DNA, 46 bp, Artificial Sequence
  Synthesized adaptor olignonucleotide
  misc_feature (34)..(36): n is a, c, g, or t
tgcaggaccagagaattcgaatacattaggccannngatcgacatg

SEQ ID NO: 2347 - DNA, 46 bp, Artificial Sequence
  Synthesized adaptor olignonucleotide
  misc_feature (34)..(36): n is a, c, g, or t
tgcaggaccagagaattcgaatacaagccctccnnngatcgacatg

SEQ ID NO: 2348 - DNA, 46 bp, Artificial Sequence
  Synthesized adaptor olignonucleotide
  misc_feature (34)..(36): n is a, c, g, or t
tgcaggaccagagaattcgaatacacggaaaacnnngatcgacatg

SEQ ID NO: 2349 - DNA, 46 bp, Artificial Sequence
  Synthesized adaptor olignonucleotide
  misc_feature (34)..(36): n is a, c, g, or t
tgcaggaccagagaattcgaatacaggccggttnnntgcatcaggt

SEQ ID NO: 2350 - DNA, 46 bp, Artificial Sequence
  Synthesized adaptor olignonucleotide
  misc_feature (34)..(36): n is a, c, g, or t
tgcaggaccagagaattcgaatacataggctacnnntgcatcaggt

SEQ ID NO: 2351 - DNA, 46 bp, Artificial Sequence
  Synthesized adaptor olignonucleotide
  misc_feature (34)..(36): n is a, c, g, or t
tgcaggaccagagaattcgaatacaccacttgtnnntgcatcaggt

SEQ ID NO: 2352 - DNA, 46 bp, Artificial Sequence
  Synthesized adaptor olignonucleotide
  misc_feature (34)..(36): n is a, c, g, or t
tgcaggaccagagaattcgaatacagatagagcnnntgcatcaggt

SEQ ID NO: 2353 - DNA, 46 bp, Artificial Sequence
  Synthesized adaptor olignonucleotide
  misc_feature (34)..(36): n is a, c, g, or t
tgcaggaccagagaattcgaatacaagtccagtnnntgcatcaggt

SEQ ID NO: 2354 - DNA, 46 bp, Artificial Sequence
  Synthesized adaptor olignonucleotide
  misc_feature (34)..(36): n is a, c, g, or t
tgcaggaccagagaattcgaatacagtcatcagnnntgcatcaggt

SEQ ID NO: 2355 - DNA, 46 bp, Artificial Sequence
  Synthesized adaptor olignonucleotide
  misc_feature (34)..(36): n is a, c, g, or t
tgcaggaccagagaattcgaatacatttcggagnnntgcatcaggt

SEQ ID NO: 2356 - DNA, 46 bp, Artificial Sequence
  Synthesized adaptor olignonucleotide
  misc_feature (34)..(36): n is a, c, g, or t
tgcaggaccagagaattcgaatacactcaggatnnntgcatcaggt

SEQ ID NO: 2357 - DNA, 46 bp, Artificial Sequence
  Synthesized adaptor olignonucleotide
  misc_feature (34)..(36): n is a, c, g, or t
tgcaggaccagagaattcgaatacacctatccannntgcatcaggt

SEQ ID NO: 2358 - DNA, 46 bp, Artificial Sequence
  Synthesized adaptor olignonucleotide
  misc_feature (34)..(36): n is a, c, g, or t
tgcaggaccagagaattcgaatacacaatgctgnnntgcatcaggt

SEQ ID NO: 2359 - DNA, 46 bp, Artificial Sequence
  Synthesized adaptor olignonucleotide
  misc_feature (34)..(36): n is a, c, g, or t
tgcaggaccagagaattcgaatacacggtgaaannntgcatcaggt

SEQ ID NO: 2360 - DNA, 46 bp, Artificial Sequence
  Synthesized adaptor olignonucleotide
  misc_feature (34)..(36): n is a, c, g, or t
tgcaggaccagagaattcgaatacagttgcaacnnntgcatcaggt

SEQ ID NO: 2361 - DNA, 46 bp, Artificial Sequence
  Synthesized adaptor olignonucleotide
  misc_feature (34)..(36): n is a, c, g, or t
tgcaggaccagagaattcgaatacagagagctannntgcatcaggt

SEQ ID NO: 2362 - DNA, 46 bp, Artificial Sequence
  Synthesized adaptor olignonucleotide
  misc_feature (34)..(36): n is a, c, g, or t
tgcaggaccagagaattcgaatacagcctaacannntgcatcaggt

SEQ ID NO: 2363 - DNA, 46 bp, Artificial Sequence
  Synthesized adaptor olignonucleotide
  misc_feature (34)..(36): n is a, c, g, or t
tgcaggaccagagaattcgaatacactgagactnnntgcatcaggt

SEQ ID NO: 2364 - DNA, 46 bp, Artificial Sequence
  Synthesized adaptor olignonucleotide
  misc_feature (34)..(36): n is a, c, g, or t
tgcaggaccagagaattcgaatacaacgttgcannntgcatcaggt

SEQ ID NO: 2365 - DNA, 46 bp, Artificial Sequence
  Synthesized adaptor olignonucleotide
  misc_feature (34)..(36): n is a, c, g, or t
tgcaggaccagagaattcgaatacaggaagctannntgcatcaggt

SEQ ID NO: 2366 - DNA, 46 bp, Artificial Sequence
  Synthesized adaptor olignonucleotide
  misc_feature (34)..(36): n is a, c, g, or t
tgcaggaccagagaattcgaatacaccctgtatnnntgcatcaggt

SEQ ID NO: 2367 - DNA, 46 bp, Artificial Sequence
  Synthesized adaptor olignonucleotide
  misc_feature (34)..(36): n is a, c, g, or t
tgcaggaccagagaattcgaatacatagcctctnnntgcatcaggt

SEQ ID NO: 2368 - DNA, 46 bp, Artificial Sequence
  Synthesized adaptor olignonucleotide
  misc_feature (34)..(36): n is a, c, g, or t
tgcaggaccagagaattcgaatacaaggtacctnnntgcatcaggt

SEQ ID NO: 2369 - DNA, 46 bp, Artificial Sequence
  Synthesized adaptor olignonucleotide
  misc_feature (34)..(36): n is a, c, g, or t
tgcaggaccagagaattcgaatacatgttatctnnntgcatcaggt

SEQ ID NO: 2370 - DNA, 46 bp, Artificial Sequence
  Synthesized adaptor olignonucleotide
  misc_feature (34)..(36): n is a, c, g, or t
tgcaggaccagagaattcgaatacagacttacgnnntgcatcaggt

SEQ ID NO: 2371 - DNA, 46 bp, Artificial Sequence
  Synthesized adaptor olignonucleotide
  misc_feature (34)..(36): n is a, c, g, or t
tgcaggaccagagaattcgaatacaacttccacnnntgcatcaggt

SEQ ID NO: 2372 - DNA, 46 bp, Artificial Sequence
  Synthesized adaptor olignonucleotide
  misc_feature (34)..(36): n is a, c, g, or t
tgcaggaccagagaattcgaatacaccttctgannntgcatcaggt

SEQ ID NO: 2373 - DNA, 46 bp, Artificial Sequence
  Synthesized adaptor olignonucleotide
  misc_feature (34)..(36): n is a, c, g, or t
tgcaggaccagagaattcgaatacacgacactannntgcatcaggt

SEQ ID NO: 2374 - DNA, 46 bp, Artificial Sequence
  Synthesized adaptor olignonucleotide
  misc_feature (34)..(36): n is a, c, g, or t
tgcaggaccagagaattcgaatacactgtgagtnnntgcatcaggt

SEQ ID NO: 2375 - DNA, 46 bp, Artificial Sequence
  Synthesized adaptor olignonucleotide
  misc_feature (34)..(36): n is a, c, g, or t
tgcaggaccagagaattcgaatacaagagacacnnntgcatcaggt

SEQ ID NO: 2376 - DNA, 46 bp, Artificial Sequence
  Synthesized adaptor olignonucleotide
  misc_feature (34)..(36): n is a, c, g, or t
tgcaggaccagagaattcgaatacataattgtgnnntgcatcaggt

SEQ ID NO: 2377 - DNA, 46 bp, Artificial Sequence
  Synthesized adaptor olignonucleotide
  misc_feature (34)..(36): n is a, c, g, or t
tgcaggaccagagaattcgaatacagtaatttgnnntgcatcaggt

SEQ ID NO: 2378 - DNA, 46 bp, Artificial Sequence
  Synthesized adaptor olignonucleotide
  misc_feature (34)..(36): n is a, c, g, or t
tgcaggaccagagaattcgaatacagatactatnnntgcatcaggt

SEQ ID NO: 2379 - DNA, 46 bp, Artificial Sequence
  Synthesized adaptor olignonucleotide
  misc_feature (34)..(36): n is a, c, g, or t
tgcaggaccagagaattcgaatacaagtggatgnnntgcatcaggt

SEQ ID NO: 2380 - DNA, 46 bp, Artificial Sequence
  Synthesized adaptor olignonucleotide
  misc_feature (34)..(36): n is a, c, g, or t
tgcaggaccagagaattcgaatacattatagacnnntgcatcaggt

SEQ ID NO: 2381 - DNA, 46 bp, Artificial Sequence
  Synthesized adaptor olignonucleotide
  misc_feature (34)..(36): n is a, c, g, or t
tgcaggaccagagaattcgaatacagagtttcgnnntgcatcaggt

SEQ ID NO: 2382 - DNA, 46 bp, Artificial Sequence
  Synthesized adaptor olignonucleotide
  misc_feature (34)..(36): n is a, c, g, or t
tgcaggaccagagaattcgaatacacagagatgnnntgcatcaggt

SEQ ID NO: 2383 - DNA, 46 bp, Artificial Sequence
  Synthesized adaptor olignonucleotide
  misc_feature (34)..(36): n is a, c, g, or t
tgcaggaccagagaattcgaatacagactcaacnnntgcatcaggt

SEQ ID NO: 2384 - DNA, 46 bp, Artificial Sequence
  Synthesized adaptor olignonucleotide
  misc_feature (34)..(36): n is a, c, g, or t
tgcaggaccagagaattcgaatacattcgctgtnnntgcatcaggt

SEQ ID NO: 2385 - DNA, 46 bp, Artificial Sequence
  Synthesized adaptor olignonucleotide
  misc_feature (34)..(36): n is a, c, g, or t
tgcaggaccagagaattcgaatacacgtccgagnnntgcatcaggt

SEQ ID NO: 2386 - DNA, 46 bp, Artificial Sequence
  Synthesized adaptor olignonucleotide
  misc_feature (34)..(36): n is a, c, g, or t
tgcaggaccagagaattcgaatacagcatgcatnnntgcatcaggt

SEQ ID NO: 2387 - DNA, 46 bp, Artificial Sequence
  Synthesized adaptor olignonucleotide
  misc_feature (34)..(36): n is a, c, g, or t
tgcaggaccagagaattcgaatacaaaagtgcgnnntgcatcaggt

SEQ ID NO: 2388 - DNA, 46 bp, Artificial Sequence
  Synthesized adaptor olignonucleotide
  misc_feature (34)..(36): n is a, c, g, or t
tgcaggaccagagaattcgaatacagaaagcacnnntgcatcaggt

SEQ ID NO: 2389 - DNA, 46 bp, Artificial Sequence
  Synthesized adaptor olignonucleotide
  misc_feature (34)..(36): n is a, c, g, or t
tgcaggaccagagaattcgaatacaggctgctgnnntgcatcaggt

SEQ ID NO: 2390 - DNA, 46 bp, Artificial Sequence
  Synthesized adaptor olignonucleotide
  misc_feature (34)..(36): n is a, c, g, or t
tgcaggaccagagaattcgaatacagcggaagcnnntgcatcaggt

SEQ ID NO: 2391 - DNA, 46 bp, Artificial Sequence
  Synthesized adaptor olignonucleotide
  misc_feature (34)..(36): n is a, c, g, or t
tgcaggaccagagaattcgaatacaatcacatannntgcatcaggt

SEQ ID NO: 2392 - DNA, 46 bp, Artificial Sequence
  Synthesized adaptor olignonucleotide
  misc_feature (34)..(36): n is a, c, g, or t
tgcaggaccagagaattcgaatacaactctctgnnntgcatcaggt

SEQ ID NO: 2393 - DNA, 46 bp, Artificial Sequence
  Synthesized adaptor olignonucleotide
  misc_feature (34)..(36): n is a, c, g, or t
tgcaggaccagagaattcgaatacacgcccccgnnntgcatcaggt

SEQ ID NO: 2394 - DNA, 46 bp, Artificial Sequence
  Synthesized adaptor olignonucleotide
  misc_feature (34)..(36): n is a, c, g, or t
tgcaggaccagagaattcgaatacatttaatccnnntgcatcaggt

SEQ ID NO: 2395 - DNA, 46 bp, Artificial Sequence
  Synthesized adaptor olignonucleotide
  misc_feature (34)..(36): n is a, c, g, or t
tgcaggaccagagaattcgaatacaccgtcggannntgcatcaggt

SEQ ID NO: 2396 - DNA, 46 bp, Artificial Sequence
  Synthesized adaptor olignonucleotide
  misc_feature (34)..(36): n is a, c, g, or t
tgcaggaccagagaattcgaatacatgagaaatnnntgcatcaggt

SEQ ID NO: 2397 - DNA, 46 bp, Artificial Sequence
  Synthesized adaptor olignonucleotide
  misc_feature (34)..(36): n is a, c, g, or t
tgcaggaccagagaattcgaatacacgttataannntgcatcaggt

SEQ ID NO: 2398 - DNA, 46 bp, Artificial Sequence
  Synthesized adaptor olignonucleotide
  misc_feature (34)..(36): n is a, c, g, or t
tgcaggaccagagaattcgaatacatctaaaacnnntgcatcaggt

SEQ ID NO: 2399 - DNA, 46 bp, Artificial Sequence
  Synthesized adaptor olignonucleotide
  misc_feature (34)..(36): n is a, c, g, or t
tgcaggaccagagaattcgaatacaacactcgannntgcatcaggt

SEQ ID NO: 2400 - DNA, 46 bp, Artificial Sequence
  Synthesized adaptor olignonucleotide
  misc_feature (34)..(36): n is a, c, g, or t
tgcaggaccagagaattcgaatacagcatcgtannntgcatcaggt

SEQ ID NO: 2401 - DNA, 46 bp, Artificial Sequence
  Synthesized adaptor olignonucleotide
  misc_feature (34)..(36): n is a, c, g, or t
tgcaggaccagagaattcgaatacagtaagacgnnntgcatcaggt

SEQ ID NO: 2402 - DNA, 46 bp, Artificial Sequence
  Synthesized adaptor olignonucleotide
  misc_feature (34)..(36): n is a, c, g, or t
tgcaggaccagagaattcgaatacaaaagccctnnntgcatcaggt

SEQ ID NO: 2403 - DNA, 46 bp, Artificial Sequence
  Synthesized adaptor olignonucleotide
  misc_feature (34)..(36): n is a, c, g, or t
tgcaggaccagagaattcgaatacaccatggtannntgcatcaggt

SEQ ID NO: 2404 - DNA, 46 bp, Artificial Sequence
  Synthesized adaptor olignonucleotide
  misc_feature (34)..(36): n is a, c, g, or t
tgcaggaccagagaattcgaatacacgaaataannntgcatcaggt

SEQ ID NO: 2405 - DNA, 46 bp, Artificial Sequence
  Synthesized adaptor olignonucleotide
  misc_feature (34)..(36): n is a, c, g, or t
tgcaggaccagagaattcgaatacagatcaaaannntgcatcaggt

SEQ ID NO: 2406 - DNA, 46 bp, Artificial Sequence
  Synthesized adaptor olignonucleotide
  misc_feature (34)..(36): n is a, c, g, or t
tgcaggaccagagaattcgaatacaagtgccgcnnntgcatcaggt

SEQ ID NO: 2407 - DNA, 46 bp, Artificial Sequence
  Synthesized adaptor olignonucleotide
  misc_feature (34)..(36): n is a, c, g, or t
tgcaggaccagagaattcgaatacaccctggctnnntgcatcaggt

SEQ ID NO: 2408 - DNA, 46 bp, Artificial Sequence
  Synthesized adaptor olignonucleotide
  misc_feature (34)..(36): n is a, c, g, or t
tgcaggaccagagaattcgaatacacaagttcgnnntgcatcaggt

SEQ ID NO: 2409 - DNA, 46 bp, Artificial Sequence
  Synthesized adaptor olignonucleotide
  misc_feature (34)..(36): n is a, c, g, or t
tgcaggaccagagaattcgaatacaatacgtatnnnacgtatgcca

SEQ ID NO: 2410 - DNA, 46 bp, Artificial Sequence
  Synthesized adaptor olignonucleotide
  misc_feature (34)..(36): n is a, c, g, or t
tgcaggaccagagaattcgaatacaaactagccnnnacgtatgcca

SEQ ID NO: 2411 - DNA, 46 bp, Artificial Sequence
  Synthesized adaptor olignonucleotide
  misc_feature (34)..(36): n is a, c, g, or t
tgcaggaccagagaattcgaatacacggattacnnnacgtatgcca

SEQ ID NO: 2412 - DNA, 46 bp, Artificial Sequence
  Synthesized adaptor olignonucleotide
  misc_feature (34)..(36): n is a, c, g, or t
tgcaggaccagagaattcgaatacaggacgcctnnnacgtatgcca

SEQ ID NO: 2413 - DNA, 46 bp, Artificial Sequence
  Synthesized adaptor olignonucleotide
  misc_feature (34)..(36): n is a, c, g, or t
tgcaggaccagagaattcgaatacacgttaaatnnnacgtatgcca

SEQ ID NO: 2414 - DNA, 46 bp, Artificial Sequence
  Synthesized adaptor olignonucleotide
  misc_feature (34)..(36): n is a, c, g, or t
tgcaggaccagagaattcgaatacaggctagttnnnacgtatgcca

SEQ ID NO: 2415 - DNA, 46 bp, Artificial Sequence
  Synthesized adaptor olignonucleotide
  misc_feature (34)..(36): n is a, c, g, or t
tgcaggaccagagaattcgaatacatcagaaggnnnacgtatgcca

SEQ ID NO: 2416 - DNA, 46 bp, Artificial Sequence
  Synthesized adaptor olignonucleotide
  misc_feature (34)..(36): n is a, c, g, or t
tgcaggaccagagaattcgaatacaaccaactgnnnacgtatgcca

SEQ ID NO: 2417 - DNA, 46 bp, Artificial Sequence
  Synthesized adaptor olignonucleotide
  misc_feature (34)..(36): n is a, c, g, or t
tgcaggaccagagaattcgaatacatcgacaacnnnacgtatgcca

SEQ ID NO: 2418 - DNA, 46 bp, Artificial Sequence
  Synthesized adaptor olignonucleotide
  misc_feature (34)..(36): n is a, c, g, or t
tgcaggaccagagaattcgaatacagtcgtacannnacgtatgcca

SEQ ID NO: 2419 - DNA, 46 bp, Artificial Sequence
  Synthesized adaptor olignonucleotide
  misc_feature (34)..(36): n is a, c, g, or t
tgcaggaccagagaattcgaatacagccagaggnnnacgtatgcca

SEQ ID NO: 2420 - DNA, 46 bp, Artificial Sequence
  Synthesized adaptor olignonucleotide
  misc_feature (34)..(36): n is a, c, g, or t
tgcaggaccagagaattcgaatacacatagtatnnnacgtatgcca

SEQ ID NO: 2421 - DNA, 46 bp, Artificial Sequence
  Synthesized adaptor olignonucleotide
  misc_feature (34)..(36): n is a, c, g, or t
tgcaggaccagagaattcgaatacataaatgtcnnnacgtatgcca

SEQ ID NO: 2422 - DNA, 46 bp, Artificial Sequence
  Synthesized adaptor olignonucleotide
  misc_feature (34)..(36): n is a, c, g, or t
tgcaggaccagagaattcgaatacagcgtcggtnnnacgtatgcca

SEQ ID NO: 2423 - DNA, 46 bp, Artificial Sequence
  Synthesized adaptor olignonucleotide
  misc_feature (34)..(36): n is a, c, g, or t
tgcaggaccagagaattcgaatacatttgaacannnacgtatgcca

SEQ ID NO: 2424 - DNA, 46 bp, Artificial Sequence
  Synthesized adaptor olignonucleotide
  misc_feature (34)..(36): n is a, c, g, or t
tgcaggaccagagaattcgaatacataactatgnnnacgtatgcca

SEQ ID NO: 2425 - DNA, 46 bp, Artificial Sequence
  Synthesized adaptor olignonucleotide
  misc_feature (34)..(36): n is a, c, g, or t
tgcaggaccagagaattcgaatacatcagatgcnnnacgtatgcca

SEQ ID NO: 2426 - DNA, 46 bp, Artificial Sequence
  Synthesized adaptor olignonucleotide
  misc_feature (34)..(36): n is a, c, g, or t
tgcaggaccagagaattcgaatacactcaacagnnnacgtatgcca

SEQ ID NO: 2427 - DNA, 46 bp, Artificial Sequence
  Synthesized adaptor olignonucleotide
  misc_feature (34)..(36): n is a, c, g, or t
tgcaggaccagagaattcgaatacaataaagtgnnnacgtatgcca

SEQ ID NO: 2428 - DNA, 46 bp, Artificial Sequence
  Synthesized adaptor olignonucleotide
  misc_feature (34)..(36): n is a, c, g, or t
tgcaggaccagagaattcgaatacaagagcagtnnnacgtatgcca

SEQ ID NO: 2429 - DNA, 46 bp, Artificial Sequence
  Synthesized adaptor olignonucleotide
  misc_feature (34)..(36): n is a, c, g, or t
tgcaggaccagagaattcgaatacatatgtcttnnnacgtatgcca

SEQ ID NO: 2430 - DNA, 46 bp, Artificial Sequence
  Synthesized adaptor olignonucleotide
  misc_feature (34)..(36): n is a, c, g, or t
tgcaggaccagagaattcgaatacagcagagatnnnacgtatgcca

SEQ ID NO: 2431 - DNA, 46 bp, Artificial Sequence
  Synthesized adaptor olignonucleotide
  misc_feature (34)..(36): n is a, c, g, or t
tgcaggaccagagaattcgaatacatctcaccannnacgtatgcca

SEQ ID NO: 2432 - DNA, 46 bp, Artificial Sequence
  Synthesized adaptor olignonucleotide
  misc_feature (34)..(36): n is a, c, g, or t
tgcaggaccagagaattcgaatacaccccttggnnnacgtatgcca

SEQ ID NO: 2433 - DNA, 46 bp, Artificial Sequence
  Synthesized adaptor olignonucleotide
  misc_feature (34)..(36): n is a, c, g, or t
tgcaggaccagagaattcgaatacacagtggccnnnacgtatgcca

SEQ ID NO: 2434 - DNA, 46 bp, Artificial Sequence
  Synthesized adaptor olignonucleotide
  misc_feature (34)..(36): n is a, c, g, or t
tgcaggaccagagaattcgaatacactgatcgannnacgtatgcca

SEQ ID NO: 2435 - DNA, 46 bp, Artificial Sequence
  Synthesized adaptor olignonucleotide
  misc_feature (34)..(36): n is a, c, g, or t
tgcaggaccagagaattcgaatacatggtacgtnnnacgtatgcca

SEQ ID NO: 2436 - DNA, 46 bp, Artificial Sequence
  Synthesized adaptor olignonucleotide
  misc_feature (34)..(36): n is a, c, g, or t
tgcaggaccagagaattcgaatacagtacggccnnnacgtatgcca

SEQ ID NO: 2437 - DNA, 46 bp, Artificial Sequence
  Synthesized adaptor olignonucleotide
  misc_feature (34)..(36): n is a, c, g, or t
tgcaggaccagagaattcgaatacaccatgcggnnnacgtatgcca

SEQ ID NO: 2438 - DNA, 46 bp, Artificial Sequence
  Synthesized adaptor olignonucleotide
  misc_feature (34)..(36): n is a, c, g, or t
tgcaggaccagagaattcgaatacacaagtaggnnnacgtatgcca

SEQ ID NO: 2439 - DNA, 46 bp, Artificial Sequence
  Synthesized adaptor olignonucleotide
  misc_feature (34)..(36): n is a, c, g, or t
tgcaggaccagagaattcgaatacacatcaaatnnnacgtatgcca

SEQ ID NO: 2440 - DNA, 46 bp, Artificial Sequence
  Synthesized adaptor olignonucleotide
  misc_feature (34)..(36): n is a, c, g, or t
tgcaggaccagagaattcgaatacagactggttnnnacgtatgcca

SEQ ID NO: 2441 - DNA, 46 bp, Artificial Sequence
  Synthesized adaptor olignonucleotide
  misc_feature (34)..(36): n is a, c, g, or t
tgcaggaccagagaattcgaatacagcaaatttnnnacgtatgcca

SEQ ID NO: 2442 - DNA, 46 bp, Artificial Sequence
  Synthesized adaptor olignonucleotide
  misc_feature (34)..(36): n is a, c, g, or t
tgcaggaccagagaattcgaatacattagtgtannnacgtatgcca

SEQ ID NO: 2443 - DNA, 46 bp, Artificial Sequence
  Synthesized adaptor olignonucleotide
  misc_feature (34)..(36): n is a, c, g, or t
tgcaggaccagagaattcgaatacagatgaaatnnnacgtatgcca

SEQ ID NO: 2444 - DNA, 46 bp, Artificial Sequence
  Synthesized adaptor olignonucleotide
  misc_feature (34)..(36): n is a, c, g, or t
tgcaggaccagagaattcgaatacattgccgaannnacgtatgcca

SEQ ID NO: 2445 - DNA, 46 bp, Artificial Sequence
  Synthesized adaptor olignonucleotide
  misc_feature (34)..(36): n is a, c, g, or t
tgcaggaccagagaattcgaatacatcctccttnnnacgtatgcca

SEQ ID NO: 2446 - DNA, 46 bp, Artificial Sequence
  Synthesized adaptor olignonucleotide
  misc_feature (34)..(36): n is a, c, g, or t
tgcaggaccagagaattcgaatacaccccattannnacgtatgcca

SEQ ID NO: 2447 - DNA, 46 bp, Artificial Sequence
  Synthesized adaptor olignonucleotide
  misc_feature (34)..(36): n is a, c, g, or t
tgcaggaccagagaattcgaatacagtttgtttnnnacgtatgcca

SEQ ID NO: 2448 - DNA, 46 bp, Artificial Sequence
  Synthesized adaptor olignonucleotide
  misc_feature (34)..(36): n is a, c, g, or t
tgcaggaccagagaattcgaatacatatcccgtnnnacgtatgcca

SEQ ID NO: 2449 - DNA, 46 bp, Artificial Sequence
  Synthesized adaptor olignonucleotide
  misc_feature (34)..(36): n is a, c, g, or t
tgcaggaccagagaattcgaatacattcggtgannnacgtatgcca

SEQ ID NO: 2450 - DNA, 46 bp, Artificial Sequence
  Synthesized adaptor olignonucleotide
  misc_feature (34)..(36): n is a, c, g, or t
tgcaggaccagagaattcgaatacacgtaaggannnacgtatgcca

SEQ ID NO: 2451 - DNA, 46 bp, Artificial Sequence
  Synthesized adaptor olignonucleotide
  misc_feature (34)..(36): n is a, c, g, or t
tgcaggaccagagaattcgaatacactttctttnnnacgtatgcca

SEQ ID NO: 2452 - DNA, 46 bp, Artificial Sequence
  Synthesized adaptor olignonucleotide
  misc_feature (34)..(36): n is a, c, g, or t
tgcaggaccagagaattcgaatacagactttttnnnacgtatgcca

SEQ ID NO: 2453 - DNA, 46 bp, Artificial Sequence
  Synthesized adaptor olignonucleotide
  misc_feature (34)..(36): n is a, c, g, or t
tgcaggaccagagaattcgaatacaggttaaggnnnacgtatgcca

SEQ ID NO: 2454 - DNA, 46 bp, Artificial Sequence
  Synthesized adaptor olignonucleotide
  misc_feature (34)..(36): n is a, c, g, or t
tgcaggaccagagaattcgaatacaatcacggtnnnacgtatgcca

SEQ ID NO: 2455 - DNA, 46 bp, Artificial Sequence
  Synthesized adaptor olignonucleotide
  misc_feature (34)..(36): n is a, c, g, or t
tgcaggaccagagaattcgaatacacatttagannnacgtatgcca

SEQ ID NO: 2456 - DNA, 46 bp, Artificial Sequence
  Synthesized adaptor olignonucleotide
  misc_feature (34)..(36): n is a, c, g, or t
tgcaggaccagagaattcgaatacacacgcgcannnacgtatgcca

SEQ ID NO: 2457 - DNA, 46 bp, Artificial Sequence
  Synthesized adaptor olignonucleotide
  misc_feature (34)..(36): n is a, c, g, or t
tgcaggaccagagaattcgaatacactgaatcgnnnacgtatgcca

SEQ ID NO: 2458 - DNA, 46 bp, Artificial Sequence
  Synthesized adaptor olignonucleotide
  misc_feature (34)..(36): n is a, c, g, or t
tgcaggaccagagaattcgaatacattgtgtaannnacgtatgcca

SEQ ID NO: 2459 - DNA, 46 bp, Artificial Sequence
  Synthesized adaptor olignonucleotide
  misc_feature (34)..(36): n is a, c, g, or t
tgcaggaccagagaattcgaatacaccgcgtgannnacgtatgcca

SEQ ID NO: 2460 - DNA, 46 bp, Artificial Sequence
  Synthesized adaptor olignonucleotide
  misc_feature (34)..(36): n is a, c, g, or t
tgcaggaccagagaattcgaatacaaaccaaggnnnacgtatgcca

SEQ ID NO: 2461 - DNA, 46 bp, Artificial Sequence
  Synthesized adaptor olignonucleotide
  misc_feature (34)..(36): n is a, c, g, or t
tgcaggaccagagaattcgaatacatcgtttgcnnnacgtatgcca

SEQ ID NO: 2462 - DNA, 46 bp, Artificial Sequence
  Synthesized adaptor olignonucleotide
  misc_feature (34)..(36): n is a, c, g, or t
tgcaggaccagagaattcgaatacactattcgcnnnacgtatgcca

SEQ ID NO: 2463 - DNA, 46 bp, Artificial Sequence
  Synthesized adaptor olignonucleotide
  misc_feature (34)..(36): n is a, c, g, or t
tgcaggaccagagaattcgaatacaaacagatannnacgtatgcca

SEQ ID NO: 2464 - DNA, 46 bp, Artificial Sequence
  Synthesized adaptor olignonucleotide
  misc_feature (34)..(36): n is a, c, g, or t
tgcaggaccagagaattcgaatacactattatcnnnacgtatgcca

SEQ ID NO: 2465 - DNA, 46 bp, Artificial Sequence
  Synthesized adaptor olignonucleotide
  misc_feature (34)..(36): n is a, c, g, or t
tgcaggaccagagaattcgaatacatcccaatcnnnacgtatgcca

SEQ ID NO: 2466 - DNA, 46 bp, Artificial Sequence
  Synthesized adaptor olignonucleotide
  misc_feature (34)..(36): n is a, c, g, or t
tgcaggaccagagaattcgaatacactaaagttnnnacgtatgcca

SEQ ID NO: 2467 - DNA, 46 bp, Artificial Sequence
  Synthesized adaptor olignonucleotide
  misc_feature (34)..(36): n is a, c, g, or t
tgcaggaccagagaattcgaatacaagctaattnnnacgtatgcca

SEQ ID NO: 2468 - DNA, 46 bp, Artificial Sequence
  Synthesized adaptor olignonucleotide
  misc_feature (34)..(36): n is a, c, g, or t
tgcaggaccagagaattcgaatacattgttatcnnnacgtatgcca

SEQ ID NO: 2469 - DNA, 46 bp, Artificial Sequence
  Synthesized adaptor olignonucleotide
  misc_feature (34)..(36): n is a, c, g, or t
tgcaggaccagagaattcgaatacatagtacgcnnnctagcgttac

SEQ ID NO: 2470 - DNA, 46 bp, Artificial Sequence
  Synthesized adaptor olignonucleotide
  misc_feature (34)..(36): n is a, c, g, or t
tgcaggaccagagaattcgaatacacaggctatnnnctagcgttac

SEQ ID NO: 2471 - DNA, 46 bp, Artificial Sequence
  Synthesized adaptor olignonucleotide
  misc_feature (34)..(36): n is a, c, g, or t
tgcaggaccagagaattcgaatacacattagtannnctagcgttac

SEQ ID NO: 2472 - DNA, 46 bp, Artificial Sequence
  Synthesized adaptor olignonucleotide
  misc_feature (34)..(36): n is a, c, g, or t
tgcaggaccagagaattcgaatacacctctaacnnnctagcgttac

SEQ ID NO: 2473 - DNA, 46 bp, Artificial Sequence
  Synthesized adaptor olignonucleotide
  misc_feature (34)..(36): n is a, c, g, or t
tgcaggaccagagaattcgaatacatagtgtcgnnnctagcgttac

SEQ ID NO: 2474 - DNA, 46 bp, Artificial Sequence
  Synthesized adaptor olignonucleotide
  misc_feature (34)..(36): n is a, c, g, or t
tgcaggaccagagaattcgaatacacgcagaggnnnctagcgttac

SEQ ID NO: 2475 - DNA, 46 bp, Artificial Sequence
  Synthesized adaptor olignonucleotide
  misc_feature (34)..(36): n is a, c, g, or t
tgcaggaccagagaattcgaatacagcggttcgnnnctagcgttac

SEQ ID NO: 2476 - DNA, 46 bp, Artificial Sequence
  Synthesized adaptor olignonucleotide
  misc_feature (34)..(36): n is a, c, g, or t
tgcaggaccagagaattcgaatacaccagagttnnnctagcgttac

SEQ ID NO: 2477 - DNA, 46 bp, Artificial Sequence
  Synthesized adaptor olignonucleotide
  misc_feature (34)..(36): n is a, c, g, or t
tgcaggaccagagaattcgaatacatgatgaaannnctagcgttac

SEQ ID NO: 2478 - DNA, 46 bp, Artificial Sequence
  Synthesized adaptor olignonucleotide
  misc_feature (34)..(36): n is a, c, g, or t
tgcaggaccagagaattcgaatacaggtgaatgnnnctagcgttac

SEQ ID NO: 2479 - DNA, 46 bp, Artificial Sequence
  Synthesized adaptor olignonucleotide
  misc_feature (34)..(36): n is a, c, g, or t
tgcaggaccagagaattcgaatacagtatgtgcnnnctagcgttac

SEQ ID NO: 2480 - DNA, 46 bp, Artificial Sequence
  Synthesized adaptor olignonucleotide
  misc_feature (34)..(36): n is a, c, g, or t
tgcaggaccagagaattcgaatacaaatactacnnnctagcgttac

SEQ ID NO: 2481 - DNA, 46 bp, Artificial Sequence
  Synthesized adaptor olignonucleotide
  misc_feature (34)..(36): n is a, c, g, or t
tgcaggaccagagaattcgaatacattcggatgnnnctagcgttac

SEQ ID NO: 2482 - DNA, 46 bp, Artificial Sequence
  Synthesized adaptor olignonucleotide
  misc_feature (34)..(36): n is a, c, g, or t
tgcaggaccagagaattcgaatacatacattagnnnctagcgttac

SEQ ID NO: 2483 - DNA, 46 bp, Artificial Sequence
  Synthesized adaptor olignonucleotide
  misc_feature (34)..(36): n is a, c, g, or t
tgcaggaccagagaattcgaatacatggcccgannnctagcgttac

SEQ ID NO: 2484 - DNA, 46 bp, Artificial Sequence
  Synthesized adaptor olignonucleotide
  misc_feature (34)..(36): n is a, c, g, or t
tgcaggaccagagaattcgaatacagttgagtcnnnctagcgttac

SEQ ID NO: 2485 - DNA, 46 bp, Artificial Sequence
  Synthesized adaptor olignonucleotide
  misc_feature (34)..(36): n is a, c, g, or t
tgcaggaccagagaattcgaatacagttagcacnnnctagcgttac

SEQ ID NO: 2486 - DNA, 46 bp, Artificial Sequence
  Synthesized adaptor olignonucleotide
  misc_feature (34)..(36): n is a, c, g, or t
tgcaggaccagagaattcgaatacaagttccctnnnctagcgttac

SEQ ID NO: 2487 - DNA, 46 bp, Artificial Sequence
  Synthesized adaptor olignonucleotide
  misc_feature (34)..(36): n is a, c, g, or t
tgcaggaccagagaattcgaatacacatggagannnctagcgttac

SEQ ID NO: 2488 - DNA, 46 bp, Artificial Sequence
  Synthesized adaptor olignonucleotide
  misc_feature (34)..(36): n is a, c, g, or t
tgcaggaccagagaattcgaatacaaatcgtcgnnnctagcgttac

SEQ ID NO: 2489 - DNA, 46 bp, Artificial Sequence
  Synthesized adaptor olignonucleotide
  misc_feature (34)..(36): n is a, c, g, or t
tgcaggaccagagaattcgaatacaactcgcaannnctagcgttac

SEQ ID NO: 2490 - DNA, 46 bp, Artificial Sequence
  Synthesized adaptor olignonucleotide
  misc_feature (34)..(36): n is a, c, g, or t
tgcaggaccagagaattcgaatacatcagccttnnnctagcgttac

SEQ ID NO: 2491 - DNA, 46 bp, Artificial Sequence
  Synthesized adaptor olignonucleotide
  misc_feature (34)..(36): n is a, c, g, or t
tgcaggaccagagaattcgaatacattgcctcannnctagcgttac

SEQ ID NO: 2492 - DNA, 46 bp, Artificial Sequence
  Synthesized adaptor olignonucleotide
  misc_feature (34)..(36): n is a, c, g, or t
tgcaggaccagagaattcgaatacaggacccacnnnctagcgttac

SEQ ID NO: 2493 - DNA, 46 bp, Artificial Sequence
  Synthesized adaptor olignonucleotide
  misc_feature (34)..(36): n is a, c, g, or t
tgcaggaccagagaattcgaatacattctccagnnnctagcgttac

SEQ ID NO: 2494 - DNA, 46 bp, Artificial Sequence
  Synthesized adaptor olignonucleotide
  misc_feature (34)..(36): n is a, c, g, or t
tgcaggaccagagaattcgaatacagtcctcgcnnnctagcgttac

SEQ ID NO: 2495 - DNA, 46 bp, Artificial Sequence
  Synthesized adaptor olignonucleotide
  misc_feature (34)..(36): n is a, c, g, or t
tgcaggaccagagaattcgaatacaaatagtctnnnctagcgttac

SEQ ID NO: 2496 - DNA, 46 bp, Artificial Sequence
  Synthesized adaptor olignonucleotide
  misc_feature (34)..(36): n is a, c, g, or t
tgcaggaccagagaattcgaatacagctggattnnnctagcgttac

SEQ ID NO: 2497 - DNA, 46 bp, Artificial Sequence
  Synthesized adaptor olignonucleotide
  misc_feature (34)..(36): n is a, c, g, or t
tgcaggaccagagaattcgaatacattcgtcacnnnctagcgttac

SEQ ID NO: 2498 - DNA, 46 bp, Artificial Sequence
  Synthesized adaptor olignonucleotide
  misc_feature (34)..(36): n is a, c, g, or t
tgcaggaccagagaattcgaatacaattatgacnnnctagcgttac

SEQ ID NO: 2499 - DNA, 46 bp, Artificial Sequence
  Synthesized adaptor olignonucleotide
  misc_feature (34)..(36): n is a, c, g, or t
tgcaggaccagagaattcgaatacattttagagnnnctagcgttac

SEQ ID NO: 2500 - DNA, 46 bp, Artificial Sequence
  Synthesized adaptor olignonucleotide
  misc_feature (34)..(36): n is a, c, g, or t
tgcaggaccagagaattcgaatacagatatactnnnctagcgttac

SEQ ID NO: 2501 - DNA, 46 bp, Artificial Sequence
  Synthesized adaptor olignonucleotide
  misc_feature (34)..(36): n is a, c, g, or t
tgcaggaccagagaattcgaatacacctacccgnnnctagcgttac

SEQ ID NO: 2502 - DNA, 46 bp, Artificial Sequence
  Synthesized adaptor olignonucleotide
  misc_feature (34)..(36): n is a, c, g, or t
tgcaggaccagagaattcgaatacaaaccttttnnnctagcgttac

SEQ ID NO: 2503 - DNA, 46 bp, Artificial Sequence
  Synthesized adaptor olignonucleotide
  misc_feature (34)..(36): n is a, c, g, or t
tgcaggaccagagaattcgaatacaatgtgtatnnnctagcgttac

SEQ ID NO: 2504 - DNA, 46 bp, Artificial Sequence
  Synthesized adaptor olignonucleotide
  misc_feature (34)..(36): n is a, c, g, or t
tgcaggaccagagaattcgaatacatcccacgcnnnctagcgttac

SEQ ID NO: 2505 - DNA, 46 bp, Artificial Sequence
  Synthesized adaptor olignonucleotide
  misc_feature (34)..(36): n is a, c, g, or t
tgcaggaccagagaattcgaatacacgcctctgnnnctagcgttac

SEQ ID NO: 2506 - DNA, 46 bp, Artificial Sequence
  Synthesized adaptor olignonucleotide
  misc_feature (34)..(36): n is a, c, g, or t
tgcaggaccagagaattcgaatacactataacannnctagcgttac

SEQ ID NO: 2507 - DNA, 46 bp, Artificial Sequence
  Synthesized adaptor olignonucleotide
  misc_feature (34)..(36): n is a, c, g, or t
tgcaggaccagagaattcgaatacagactgactnnnctagcgttac

SEQ ID NO: 2508 - DNA, 46 bp, Artificial Sequence
  Synthesized adaptor olignonucleotide
  misc_feature (34)..(36): n is a, c, g, or t
tgcaggaccagagaattcgaatacactggccagnnnctagcgttac

SEQ ID NO: 2509 - DNA, 46 bp, Artificial Sequence
  Synthesized adaptor olignonucleotide
  misc_feature (34)..(36): n is a, c, g, or t
tgcaggaccagagaattcgaatacaaagccaagnnnctagcgttac

SEQ ID NO: 2510 - DNA, 46 bp, Artificial Sequence
  Synthesized adaptor olignonucleotide
  misc_feature (34)..(36): n is a, c, g, or t
tgcaggaccagagaattcgaatacacgcttttgnnnctagcgttac

SEQ ID NO: 2511 - DNA, 46 bp, Artificial Sequence
  Synthesized adaptor olignonucleotide
  misc_feature (34)..(36): n is a, c, g, or t
tgcaggaccagagaattcgaatacatttccctcnnnctagcgttac

SEQ ID NO: 2512 - DNA, 46 bp, Artificial Sequence
  Synthesized adaptor olignonucleotide
  misc_feature (34)..(36): n is a, c, g, or t
tgcaggaccagagaattcgaatacacttactcgnnnctagcgttac

SEQ ID NO: 2513 - DNA, 46 bp, Artificial Sequence
  Synthesized adaptor olignonucleotide
  misc_feature (34)..(36): n is a, c, g, or t
tgcaggaccagagaattcgaatacaatcgagtcnnnctagcgttac

SEQ ID NO: 2514 - DNA, 46 bp, Artificial Sequence
  Synthesized adaptor olignonucleotide
  misc_feature (34)..(36): n is a, c, g, or t
tgcaggaccagagaattcgaatacattgtacggnnnctagcgttac

SEQ ID NO: 2515 - DNA, 46 bp, Artificial Sequence
  Synthesized adaptor olignonucleotide
  misc_feature (34)..(36): n is a, c, g, or t
tgcaggaccagagaattcgaatacacaccattcnnnctagcgttac

SEQ ID NO: 2516 - DNA, 46 bp, Artificial Sequence
  Synthesized adaptor olignonucleotide
  misc_feature (34)..(36): n is a, c, g, or t
tgcaggaccagagaattcgaatacaccctctttnnnctagcgttac

SEQ ID NO: 2517 - DNA, 46 bp, Artificial Sequence
  Synthesized adaptor olignonucleotide
  misc_feature (34)..(36): n is a, c, g, or t
tgcaggaccagagaattcgaatacatgcattaannnctagcgttac

SEQ ID NO: 2518 - DNA, 46 bp, Artificial Sequence
  Synthesized adaptor olignonucleotide
  misc_feature (34)..(36): n is a, c, g, or t
tgcaggaccagagaattcgaatacacgtagcgcnnnctagcgttac

SEQ ID NO: 2519 - DNA, 46 bp, Artificial Sequence
  Synthesized adaptor olignonucleotide
  misc_feature (34)..(36): n is a, c, g, or t
tgcaggaccagagaattcgaatacagtctcctannnctagcgttac

SEQ ID NO: 2520 - DNA, 46 bp, Artificial Sequence
  Synthesized adaptor olignonucleotide
  misc_feature (34)..(36): n is a, c, g, or t
tgcaggaccagagaattcgaatacatgcgccgannnctagcgttac

SEQ ID NO: 2521 - DNA, 46 bp, Artificial Sequence
  Synthesized adaptor olignonucleotide
  misc_feature (34)..(36): n is a, c, g, or t
tgcaggaccagagaattcgaatacacaatgattnnnctagcgttac

SEQ ID NO: 2522 - DNA, 46 bp, Artificial Sequence
  Synthesized adaptor olignonucleotide
  misc_feature (34)..(36): n is a, c, g, or t
tgcaggaccagagaattcgaatacaagcgaggcnnnctagcgttac

SEQ ID NO: 2523 - DNA, 46 bp, Artificial Sequence
  Synthesized adaptor olignonucleotide
  misc_feature (34)..(36): n is a, c, g, or t
tgcaggaccagagaattcgaatacattgaatacnnnctagcgttac

SEQ ID NO: 2524 - DNA, 46 bp, Artificial Sequence
  Synthesized adaptor olignonucleotide
  misc_feature (34)..(36): n is a, c, g, or t
tgcaggaccagagaattcgaatacaaccgccagnnnctagcgttac

SEQ ID NO: 2525 - DNA, 46 bp, Artificial Sequence
  Synthesized adaptor olignonucleotide
  misc_feature (34)..(36): n is a, c, g, or t
tgcaggaccagagaattcgaatacaggcgacagnnnctagcgttac

SEQ ID NO: 2526 - DNA, 46 bp, Artificial Sequence
  Synthesized adaptor olignonucleotide
  misc_feature (34)..(36): n is a, c, g, or t
tgcaggaccagagaattcgaatacaatatccaannnctagcgttac

SEQ ID NO: 2527 - DNA, 46 bp, Artificial Sequence
  Synthesized adaptor olignonucleotide
  misc_feature (34)..(36): n is a, c, g, or t
tgcaggaccagagaattcgaatacaatgttgtannnctagcgttac

SEQ ID NO: 2528 - DNA, 46 bp, Artificial Sequence
  Synthesized adaptor olignonucleotide
  misc_feature (34)..(36): n is a, c, g, or t
tgcaggaccagagaattcgaatacagattgttannnctagcgttac

SEQ ID NO: 2529 - DNA, 46 bp, Artificial Sequence
  Synthesized adaptor olignonucleotide
  misc_feature (34)..(36): n is a, c, g, or t
tgcaggaccagagaattcgaatacagtccacggnnngatcgacatg

SEQ ID NO: 2530 - DNA, 46 bp, Artificial Sequence
  Synthesized adaptor olignonucleotide
  misc_feature (34)..(36): n is a, c, g, or t
tgcaggaccagagaattcgaatacatgactgacnnngatcgacatg

SEQ ID NO: 2531 - DNA, 46 bp, Artificial Sequence
  Synthesized adaptor olignonucleotide
  misc_feature (34)..(36): n is a, c, g, or t
tgcaggaccagagaattcgaatacatgatttagnnngatcgacatg

SEQ ID NO: 2532 - DNA, 46 bp, Artificial Sequence
  Synthesized adaptor olignonucleotide
  misc_feature (34)..(36): n is a, c, g, or t
tgcaggaccagagaattcgaatacaacatactannngatcgacatg

SEQ ID NO: 2533 - DNA, 46 bp, Artificial Sequence
  Synthesized adaptor olignonucleotide
  misc_feature (34)..(36): n is a, c, g, or t
tgcaggaccagagaattcgaatacaagcatccannngatcgacatg

SEQ ID NO: 2534 - DNA, 46 bp, Artificial Sequence
  Synthesized adaptor olignonucleotide
  misc_feature (34)..(36): n is a, c, g, or t
tgcaggaccagagaattcgaatacaacggcaaannngatcgacatg

SEQ ID NO: 2535 - DNA, 46 bp, Artificial Sequence
  Synthesized adaptor olignonucleotide
  misc_feature (34)..(36): n is a, c, g, or t
tgcaggaccagagaattcgaatacactttgctgnnngatcgacatg

SEQ ID NO: 2536 - DNA, 46 bp, Artificial Sequence
  Synthesized adaptor olignonucleotide
  misc_feature (34)..(36): n is a, c, g, or t
tgcaggaccagagaattcgaatacattaactagnnngatcgacatg

SEQ ID NO: 2537 - DNA, 46 bp, Artificial Sequence
  Synthesized adaptor olignonucleotide
  misc_feature (34)..(36): n is a, c, g, or t
tgcaggaccagagaattcgaatacacgtactgannngatcgacatg

SEQ ID NO: 2538 - DNA, 46 bp, Artificial Sequence
  Synthesized adaptor olignonucleotide
  misc_feature (34)..(36): n is a, c, g, or t
tgcaggaccagagaattcgaatacatagtatcannngatcgacatg

SEQ ID NO: 2539 - DNA, 46 bp, Artificial Sequence
  Synthesized adaptor olignonucleotide
  misc_feature (34)..(36): n is a, c, g, or t
tgcaggaccagagaattcgaatacacctgacaannngatcgacatg

SEQ ID NO: 2540 - DNA, 46 bp, Artificial Sequence
  Synthesized adaptor olignonucleotide
  misc_feature (34)..(36): n is a, c, g, or t
tgcaggaccagagaattcgaatacacgtggccannngatcgacatg

SEQ ID NO: 2541 - DNA, 46 bp, Artificial Sequence
  Synthesized adaptor olignonucleotide
  misc_feature (34)..(36): n is a, c, g, or t
tgcaggaccagagaattcgaatacagcgtatacnnngatcgacatg

SEQ ID NO: 2542 - DNA, 46 bp, Artificial Sequence
  Synthesized adaptor olignonucleotide
  misc_feature (34)..(36): n is a, c, g, or t
tgcaggaccagagaattcgaatacagcgctgcannngatcgacatg

SEQ ID NO: 2543 - DNA, 46 bp, Artificial Sequence
  Synthesized adaptor olignonucleotide
  misc_feature (34)..(36): n is a, c, g, or t
tgcaggaccagagaattcgaatacaaccgttagnnngatcgacatg

SEQ ID NO: 2544 - DNA, 46 bp, Artificial Sequence
  Synthesized adaptor olignonucleotide
  misc_feature (34)..(36): n is a, c, g, or t
tgcaggaccagagaattcgaatacatgtactttnnngatcgacatg

SEQ ID NO: 2545 - DNA, 46 bp, Artificial Sequence
  Synthesized adaptor olignonucleotide
  misc_feature (34)..(36): n is a, c, g, or t
tgcaggaccagagaattcgaatacacattatgannngatcgacatg

SEQ ID NO: 2546 - DNA, 46 bp, Artificial Sequence
  Synthesized adaptor olignonucleotide
  misc_feature (34)..(36): n is a, c, g, or t
tgcaggaccagagaattcgaatacacagacccgnnngatcgacatg

SEQ ID NO: 2547 - DNA, 46 bp, Artificial Sequence
  Synthesized adaptor olignonucleotide
  misc_feature (34)..(36): n is a, c, g, or t
tgcaggaccagagaattcgaatacatagcaccannngatcgacatg

SEQ ID NO: 2548 - DNA, 46 bp, Artificial Sequence
  Synthesized adaptor olignonucleotide
  misc_feature (34)..(36): n is a, c, g, or t
tgcaggaccagagaattcgaatacatggagtgannngatcgacatg

SEQ ID NO: 2549 - DNA, 46 bp, Artificial Sequence
  Synthesized adaptor olignonucleotide
  misc_feature (34)..(36): n is a, c, g, or t
tgcaggaccagagaattcgaatacaggacgtggnnngatcgacatg

SEQ ID NO: 2550 - DNA, 46 bp, Artificial Sequence
  Synthesized adaptor olignonucleotide
  misc_feature (34)..(36): n is a, c, g, or t
tgcaggaccagagaattcgaatacaccttacacnnngatcgacatg

SEQ ID NO: 2551 - DNA, 46 bp, Artificial Sequence
  Synthesized adaptor olignonucleotide
  misc_feature (34)..(36): n is a, c, g, or t
tgcaggaccagagaattcgaatacatggcagccnnngatcgacatg

SEQ ID NO: 2552 - DNA, 46 bp, Artificial Sequence
  Synthesized adaptor olignonucleotide
  misc_feature (34)..(36): n is a, c, g, or t
tgcaggaccagagaattcgaatacaccttactgnnngatcgacatg

SEQ ID NO: 2553 - DNA, 46 bp, Artificial Sequence
  Synthesized adaptor olignonucleotide
  misc_feature (34)..(36): n is a, c, g, or t
tgcaggaccagagaattcgaatacattactctannngatcgacatg

SEQ ID NO: 2554 - DNA, 46 bp, Artificial Sequence
  Synthesized adaptor olignonucleotide
  misc_feature (34)..(36): n is a, c, g, or t
tgcaggaccagagaattcgaatacaccgcctacnnngatcgacatg

SEQ ID NO: 2555 - DNA, 46 bp, Artificial Sequence
  Synthesized adaptor olignonucleotide
  misc_feature (34)..(36): n is a, c, g, or t
tgcaggaccagagaattcgaatacaccttagagnnngatcgacatg

SEQ ID NO: 2556 - DNA, 46 bp, Artificial Sequence
  Synthesized adaptor olignonucleotide
  misc_feature (34)..(36): n is a, c, g, or t
tgcaggaccagagaattcgaatacattctatgtnnngatcgacatg

SEQ ID NO: 2557 - DNA, 46 bp, Artificial Sequence
  Synthesized adaptor olignonucleotide
  misc_feature (34)..(36): n is a, c, g, or t
tgcaggaccagagaattcgaatacattttacacnnngatcgacatg

SEQ ID NO: 2558 - DNA, 46 bp, Artificial Sequence
  Synthesized adaptor olignonucleotide
  misc_feature (34)..(36): n is a, c, g, or t
tgcaggaccagagaattcgaatacattgttttgnnngatcgacatg

SEQ ID NO: 2559 - DNA, 46 bp, Artificial Sequence
  Synthesized adaptor olignonucleotide
  misc_feature (34)..(36): n is a, c, g, or t
tgcaggaccagagaattcgaatacacaaagacgnnngatcgacatg

SEQ ID NO: 2560 - DNA, 46 bp, Artificial Sequence
  Synthesized adaptor olignonucleotide
  misc_feature (34)..(36): n is a, c, g, or t
tgcaggaccagagaattcgaatacaacctccgcnnngatcgacatg

SEQ ID NO: 2561 - DNA, 46 bp, Artificial Sequence
  Synthesized adaptor olignonucleotide
  misc_feature (34)..(36): n is a, c, g, or t
tgcaggaccagagaattcgaatacagttaacatnnngatcgacatg

SEQ ID NO: 2562 - DNA, 46 bp, Artificial Sequence
  Synthesized adaptor olignonucleotide
  misc_feature (34)..(36): n is a, c, g, or t
tgcaggaccagagaattcgaatacacgatgcgcnnngatcgacatg

SEQ ID NO: 2563 - DNA, 46 bp, Artificial Sequence
  Synthesized adaptor olignonucleotide
  misc_feature (34)..(36): n is a, c, g, or t
tgcaggaccagagaattcgaatacacctcgaaannngatcgacatg

SEQ ID NO: 2564 - DNA, 46 bp, Artificial Sequence
  Synthesized adaptor olignonucleotide
  misc_feature (34)..(36): n is a, c, g, or t
tgcaggaccagagaattcgaatacaatgtcgacnnngatcgacatg

SEQ ID NO: 2565 - DNA, 46 bp, Artificial Sequence
  Synthesized adaptor olignonucleotide
  misc_feature (34)..(36): n is a, c, g, or t
tgcaggaccagagaattcgaatacataacagccnnngatcgacatg

SEQ ID NO: 2566 - DNA, 46 bp, Artificial Sequence
  Synthesized adaptor olignonucleotide
  misc_feature (34)..(36): n is a, c, g, or t
tgcaggaccagagaattcgaatacagcgcagtcnnngatcgacatg

SEQ ID NO: 2567 - DNA, 46 bp, Artificial Sequence
  Synthesized adaptor olignonucleotide
  misc_feature (34)..(36): n is a, c, g, or t
tgcaggaccagagaattcgaatacaatcataacnnngatcgacatg

SEQ ID NO: 2568 - DNA, 46 bp, Artificial Sequence
  Synthesized adaptor olignonucleotide
  misc_feature (34)..(36): n is a, c, g, or t
tgcaggaccagagaattcgaatacaaaggtctcnnngatcgacatg

SEQ ID NO: 2569 - DNA, 46 bp, Artificial Sequence
  Synthesized adaptor olignonucleotide
  misc_feature (34)..(36): n is a, c, g, or t
tgcaggaccagagaattcgaatacagaaatacannngatcgacatg

SEQ ID NO: 2570 - DNA, 46 bp, Artificial Sequence
  Synthesized adaptor olignonucleotide
  misc_feature (34)..(36): n is a, c, g, or t
tgcaggaccagagaattcgaatacaacgtactgnnngatcgacatg

SEQ ID NO: 2571 - DNA, 46 bp, Artificial Sequence
  Synthesized adaptor olignonucleotide
  misc_feature (34)..(36): n is a, c, g, or t
tgcaggaccagagaattcgaatacaattaagtcnnngatcgacatg

SEQ ID NO: 2572 - DNA, 46 bp, Artificial Sequence
  Synthesized adaptor olignonucleotide
  misc_feature (34)..(36): n is a, c, g, or t
tgcaggaccagagaattcgaatacacgtgaaagnnngatcgacatg

SEQ ID NO: 2573 - DNA, 46 bp, Artificial Sequence
  Synthesized adaptor olignonucleotide
  misc_feature (34)..(36): n is a, c, g, or t
tgcaggaccagagaattcgaatacaggttaattnnngatcgacatg

SEQ ID NO: 2574 - DNA, 46 bp, Artificial Sequence
  Synthesized adaptor olignonucleotide
  misc_feature (34)..(36): n is a, c, g, or t
tgcaggaccagagaattcgaatacatgacacgtnnngatcgacatg

SEQ ID NO: 2575 - DNA, 46 bp, Artificial Sequence
  Synthesized adaptor olignonucleotide
  misc_feature (34)..(36): n is a, c, g, or t
tgcaggaccagagaattcgaatacacccagtggnnngatcgacatg

SEQ ID NO: 2576 - DNA, 46 bp, Artificial Sequence
  Synthesized adaptor olignonucleotide
  misc_feature (34)..(36): n is a, c, g, or t
tgcaggaccagagaattcgaatacatccaaggtnnngatcgacatg

SEQ ID NO: 2577 - DNA, 46 bp, Artificial Sequence
  Synthesized adaptor olignonucleotide
  misc_feature (34)..(36): n is a, c, g, or t
tgcaggaccagagaattcgaatacatgagtattnnngatcgacatg

SEQ ID NO: 2578 - DNA, 46 bp, Artificial Sequence
  Synthesized adaptor olignonucleotide
  misc_feature (34)..(36): n is a, c, g, or t
tgcaggaccagagaattcgaatacatgtacggtnnngatcgacatg

SEQ ID NO: 2579 - DNA, 46 bp, Artificial Sequence
  Synthesized adaptor olignonucleotide
  misc_feature (34)..(36): n is a, c, g, or t
tgcaggaccagagaattcgaatacacgcgtcagnnngatcgacatg

SEQ ID NO: 2580 - DNA, 46 bp, Artificial Sequence
  Synthesized adaptor olignonucleotide
  misc_feature (34)..(36): n is a, c, g, or t
tgcaggaccagagaattcgaatacacggatgttnnngatcgacatg

SEQ ID NO: 2581 - DNA, 46 bp, Artificial Sequence
  Synthesized adaptor olignonucleotide
  misc_feature (34)..(36): n is a, c, g, or t
tgcaggaccagagaattcgaatacagacaaggtnnngatcgacatg

SEQ ID NO: 2582 - DNA, 46 bp, Artificial Sequence
  Synthesized adaptor olignonucleotide
  misc_feature (34)..(36): n is a, c, g, or t
tgcaggaccagagaattcgaatacaattaaaaannngatcgacatg

SEQ ID NO: 2583 - DNA, 46 bp, Artificial Sequence
  Synthesized adaptor olignonucleotide
  misc_feature (34)..(36): n is a, c, g, or t
tgcaggaccagagaattcgaatacaacgacccgnnngatcgacatg

SEQ ID NO: 2584 - DNA, 46 bp, Artificial Sequence
  Synthesized adaptor olignonucleotide
  misc_feature (34)..(36): n is a, c, g, or t
tgcaggaccagagaattcgaatacatcaaactannngatcgacatg

SEQ ID NO: 2585 - DNA, 46 bp, Artificial Sequence
  Synthesized adaptor olignonucleotide
  misc_feature (34)..(36): n is a, c, g, or t
tgcaggaccagagaattcgaatacacacgccgannngatcgacatg

SEQ ID NO: 2586 - DNA, 46 bp, Artificial Sequence
  Synthesized adaptor olignonucleotide
  misc_feature (34)..(36): n is a, c, g, or t
tgcaggaccagagaattcgaatacacgatcagtnnngatcgacatg

SEQ ID NO: 2587 - DNA, 46 bp, Artificial Sequence
  Synthesized adaptor olignonucleotide
  misc_feature (34)..(36): n is a, c, g, or t
tgcaggaccagagaattcgaatacacactttgcnnngatcgacatg

SEQ ID NO: 2588 - DNA, 46 bp, Artificial Sequence
  Synthesized adaptor olignonucleotide
  misc_feature (34)..(36): n is a, c, g, or t
tgcaggaccagagaattcgaatacatcctgatcnnngatcgacatg

SEQ ID NO: 2589 - DNA, 46 bp, Artificial Sequence
  Synthesized adaptor olignonucleotide
  misc_feature (34)..(36): n is a, c, g, or t
tgcaggaccagagaattcgaatacagaactccannntgcatcaggt

SEQ ID NO: 2590 - DNA, 46 bp, Artificial Sequence
  Synthesized adaptor olignonucleotide
  misc_feature (34)..(36): n is a, c, g, or t
tgcaggaccagagaattcgaatacaggtcaatcnnntgcatcaggt

SEQ ID NO: 2591 - DNA, 46 bp, Artificial Sequence
  Synthesized adaptor olignonucleotide
  misc_feature (34)..(36): n is a, c, g, or t
tgcaggaccagagaattcgaatacatatgcagcnnntgcatcaggt

SEQ ID NO: 2592 - DNA, 46 bp, Artificial Sequence
  Synthesized adaptor olignonucleotide
  misc_feature (34)..(36): n is a, c, g, or t
tgcaggaccagagaattcgaatacagcacctccnnntgcatcaggt

SEQ ID NO: 2593 - DNA, 46 bp, Artificial Sequence
  Synthesized adaptor olignonucleotide
  misc_feature (34)..(36): n is a, c, g, or t
tgcaggaccagagaattcgaatacatcaagtgcnnntgcatcaggt

SEQ ID NO: 2594 - DNA, 46 bp, Artificial Sequence
  Synthesized adaptor olignonucleotide
  misc_feature (34)..(36): n is a, c, g, or t
tgcaggaccagagaattcgaatacattgccgttnnntgcatcaggt

SEQ ID NO: 2595 - DNA, 46 bp, Artificial Sequence
  Synthesized adaptor olignonucleotide
  misc_feature (34)..(36): n is a, c, g, or t
tgcaggaccagagaattcgaatacagtggagtannntgcatcaggt

SEQ ID NO: 2596 - DNA, 46 bp, Artificial Sequence
  Synthesized adaptor olignonucleotide
  misc_feature (34)..(36): n is a, c, g, or t
tgcaggaccagagaattcgaatacagcctcaccnnntgcatcaggt

SEQ ID NO: 2597 - DNA, 46 bp, Artificial Sequence
  Synthesized adaptor olignonucleotide
  misc_feature (34)..(36): n is a, c, g, or t
tgcaggaccagagaattcgaatacaacacaccannntgcatcaggt

SEQ ID NO: 2598 - DNA, 46 bp, Artificial Sequence
  Synthesized adaptor olignonucleotide
  misc_feature (34)..(36): n is a, c, g, or t
tgcaggaccagagaattcgaatacaaccccattnnntgcatcaggt

SEQ ID NO: 2599 - DNA, 46 bp, Artificial Sequence
  Synthesized adaptor olignonucleotide
  misc_feature (34)..(36): n is a, c, g, or t
tgcaggaccagagaattcgaatacaatagtctannntgcatcaggt

SEQ ID NO: 2600 - DNA, 46 bp, Artificial Sequence
  Synthesized adaptor olignonucleotide
  misc_feature (34)..(36): n is a, c, g, or t
tgcaggaccagagaattcgaatacagaatgtccnnntgcatcaggt

SEQ ID NO: 2601 - DNA, 46 bp, Artificial Sequence
  Synthesized adaptor olignonucleotide
  misc_feature (34)..(36): n is a, c, g, or t
tgcaggaccagagaattcgaatacactagatcgnnntgcatcaggt

SEQ ID NO: 2602 - DNA, 46 bp, Artificial Sequence
  Synthesized adaptor olignonucleotide
  misc_feature (34)..(36): n is a, c, g, or t
tgcaggaccagagaattcgaatacaggcaacccnnntgcatcaggt

SEQ ID NO: 2603 - DNA, 46 bp, Artificial Sequence
  Synthesized adaptor olignonucleotide
  misc_feature (34)..(36): n is a, c, g, or t
tgcaggaccagagaattcgaatacaggagagaannntgcatcaggt

SEQ ID NO: 2604 - DNA, 46 bp, Artificial Sequence
  Synthesized adaptor olignonucleotide
  misc_feature (34)..(36): n is a, c, g, or t
tgcaggaccagagaattcgaatacagttgtcctnnntgcatcaggt

SEQ ID NO: 2605 - DNA, 46 bp, Artificial Sequence
  Synthesized adaptor olignonucleotide
  misc_feature (34)..(36): n is a, c, g, or t
tgcaggaccagagaattcgaatacatggcatacnnntgcatcaggt

SEQ ID NO: 2606 - DNA, 46 bp, Artificial Sequence
  Synthesized adaptor olignonucleotide
  misc_feature (34)..(36): n is a, c, g, or t
tgcaggaccagagaattcgaatacagaggcaatnnntgcatcaggt

SEQ ID NO: 2607 - DNA, 46 bp, Artificial Sequence
  Synthesized adaptor olignonucleotide
  misc_feature (34)..(36): n is a, c, g, or t
tgcaggaccagagaattcgaatacatctcacgtnnntgcatcaggt

SEQ ID NO: 2608 - DNA, 46 bp, Artificial Sequence
  Synthesized adaptor olignonucleotide
  misc_feature (34)..(36): n is a, c, g, or t
tgcaggaccagagaattcgaatacactgcggcannntgcatcaggt

SEQ ID NO: 2609 - DNA, 46 bp, Artificial Sequence
  Synthesized adaptor olignonucleotide
  misc_feature (34)..(36): n is a, c, g, or t
tgcaggaccagagaattcgaatacacttaatgannntgcatcaggt

SEQ ID NO: 2610 - DNA, 46 bp, Artificial Sequence
  Synthesized adaptor olignonucleotide
  misc_feature (34)..(36): n is a, c, g, or t
tgcaggaccagagaattcgaatacaaactcacgnnntgcatcaggt

SEQ ID NO: 2611 - DNA, 46 bp, Artificial Sequence
  Synthesized adaptor olignonucleotide
  misc_feature (34)..(36): n is a, c, g, or t
tgcaggaccagagaattcgaatacaagcagtgannntgcatcaggt

SEQ ID NO: 2612 - DNA, 46 bp, Artificial Sequence
  Synthesized adaptor olignonucleotide
  misc_feature (34)..(36): n is a, c, g, or t
tgcaggaccagagaattcgaatacataatactgnnntgcatcaggt

SEQ ID NO: 2613 - DNA, 46 bp, Artificial Sequence
  Synthesized adaptor olignonucleotide
  misc_feature (34)..(36): n is a, c, g, or t
tgcaggaccagagaattcgaatacaaaagtcccnnntgcatcaggt

SEQ ID NO: 2614 - DNA, 46 bp, Artificial Sequence
  Synthesized adaptor olignonucleotide
  misc_feature (34)..(36): n is a, c, g, or t
tgcaggaccagagaattcgaatacagctggaaannntgcatcaggt

SEQ ID NO: 2615 - DNA, 46 bp, Artificial Sequence
  Synthesized adaptor olignonucleotide
  misc_feature (34)..(36): n is a, c, g, or t
tgcaggaccagagaattcgaatacaaagaggagnnntgcatcaggt

SEQ ID NO: 2616 - DNA, 46 bp, Artificial Sequence
  Synthesized adaptor olignonucleotide
  misc_feature (34)..(36): n is a, c, g, or t
tgcaggaccagagaattcgaatacagtggaagtnnntgcatcaggt

SEQ ID NO: 2617 - DNA, 46 bp, Artificial Sequence
  Synthesized adaptor olignonucleotide
  misc_feature (34)..(36): n is a, c, g, or t
tgcaggaccagagaattcgaatacacgcggactnnntgcatcaggt

SEQ ID NO: 2618 - DNA, 46 bp, Artificial Sequence
  Synthesized adaptor olignonucleotide
  misc_feature (34)..(36): n is a, c, g, or t
tgcaggaccagagaattcgaatacatacttgttnnntgcatcaggt

SEQ ID NO: 2619 - DNA, 46 bp, Artificial Sequence
  Synthesized adaptor olignonucleotide
  misc_feature (34)..(36): n is a, c, g, or t
tgcaggaccagagaattcgaatacaaactgaccnnntgcatcaggt

SEQ ID NO: 2620 - DNA, 46 bp, Artificial Sequence
  Synthesized adaptor olignonucleotide
  misc_feature (34)..(36): n is a, c, g, or t
tgcaggaccagagaattcgaatacatgctggtannntgcatcaggt

SEQ ID NO: 2621 - DNA, 46 bp, Artificial Sequence
  Synthesized adaptor olignonucleotide
  misc_feature (34)..(36): n is a, c, g, or t
tgcaggaccagagaattcgaatacaatatttttnnntgcatcaggt

SEQ ID NO: 2622 - DNA, 46 bp, Artificial Sequence
  Synthesized adaptor olignonucleotide
  misc_feature (34)..(36): n is a, c, g, or t
tgcaggaccagagaattcgaatacatccccatannntgcatcaggt

SEQ ID NO: 2623 - DNA, 46 bp, Artificial Sequence
  Synthesized adaptor olignonucleotide
  misc_feature (34)..(36): n is a, c, g, or t
tgcaggaccagagaattcgaatacacaagttgcnnntgcatcaggt

SEQ ID NO: 2624 - DNA, 46 bp, Artificial Sequence
  Synthesized adaptor olignonucleotide
  misc_feature (34)..(36): n is a, c, g, or t
tgcaggaccagagaattcgaatacatgaaccgtnnntgcatcaggt

SEQ ID NO: 2625 - DNA, 46 bp, Artificial Sequence
  Synthesized adaptor olignonucleotide
  misc_feature (34)..(36): n is a, c, g, or t
tgcaggaccagagaattcgaatacacgcattgannntgcatcaggt

SEQ ID NO: 2626 - DNA, 46 bp, Artificial Sequence
  Synthesized adaptor olignonucleotide
  misc_feature (34)..(36): n is a, c, g, or t
tgcaggaccagagaattcgaatacacggcgttgnnntgcatcaggt

SEQ ID NO: 2627 - DNA, 46 bp, Artificial Sequence
  Synthesized adaptor olignonucleotide
  misc_feature (34)..(36): n is a, c, g, or t
tgcaggaccagagaattcgaatacacccgcccgnnntgcatcaggt

SEQ ID NO: 2628 - DNA, 46 bp, Artificial Sequence
  Synthesized adaptor olignonucleotide
  misc_feature (34)..(36): n is a, c, g, or t
tgcaggaccagagaattcgaatacacaagctacnnntgcatcaggt

SEQ ID NO: 2629 - DNA, 46 bp, Artificial Sequence
  Synthesized adaptor olignonucleotide
  misc_feature (34)..(36): n is a, c, g, or t
tgcaggaccagagaattcgaatacacggttcaannntgcatcaggt

SEQ ID NO: 2630 - DNA, 46 bp, Artificial Sequence
  Synthesized adaptor olignonucleotide
  misc_feature (34)..(36): n is a, c, g, or t
tgcaggaccagagaattcgaatacacaacgttgnnntgcatcaggt

SEQ ID NO: 2631 - DNA, 46 bp, Artificial Sequence
  Synthesized adaptor olignonucleotide
  misc_feature (34)..(36): n is a, c, g, or t
tgcaggaccagagaattcgaatacagtactagcnnntgcatcaggt

SEQ ID NO: 2632 - DNA, 46 bp, Artificial Sequence
  Synthesized adaptor olignonucleotide
  misc_feature (34)..(36): n is a, c, g, or t
tgcaggaccagagaattcgaatacatgagtgtcnnntgcatcaggt

SEQ ID NO: 2633 - DNA, 46 bp, Artificial Sequence
  Synthesized adaptor olignonucleotide
  misc_feature (34)..(36): n is a, c, g, or t
tgcaggaccagagaattcgaatacacaaacaggnnntgcatcaggt

SEQ ID NO: 2634 - DNA, 46 bp, Artificial Sequence
  Synthesized adaptor olignonucleotide
  misc_feature (34)..(36): n is a, c, g, or t
tgcaggaccagagaattcgaatacagcatgctannntgcatcaggt

SEQ ID NO: 2635 - DNA, 46 bp, Artificial Sequence
  Synthesized adaptor olignonucleotide
  misc_feature (34)..(36): n is a, c, g, or t
tgcaggaccagagaattcgaatacagattcacgnnntgcatcaggt

SEQ ID NO: 2636 - DNA, 46 bp, Artificial Sequence
  Synthesized adaptor olignonucleotide
  misc_feature (34)..(36): n is a, c, g, or t
tgcaggaccagagaattcgaatacagtagatccnnntgcatcaggt

SEQ ID NO: 2637 - DNA, 46 bp, Artificial Sequence
  Synthesized adaptor olignonucleotide
  misc_feature (34)..(36): n is a, c, g, or t
tgcaggaccagagaattcgaatacacgccaacgnnntgcatcaggt

SEQ ID NO: 2638 - DNA, 46 bp, Artificial Sequence
  Synthesized adaptor olignonucleotide
  misc_feature (34)..(36): n is a, c, g, or t
tgcaggaccagagaattcgaatacagagcatagnnntgcatcaggt

SEQ ID NO: 2639 - DNA, 46 bp, Artificial Sequence
  Synthesized adaptor olignonucleotide
  misc_feature (34)..(36): n is a, c, g, or t
tgcaggaccagagaattcgaatacaggtgtcatnnntgcatcaggt

SEQ ID NO: 2640 - DNA, 46 bp, Artificial Sequence
  Synthesized adaptor olignonucleotide
  misc_feature (34)..(36): n is a, c, g, or t
tgcaggaccagagaattcgaatacatcttcgacnnntgcatcaggt

SEQ ID NO: 2641 - DNA, 46 bp, Artificial Sequence
  Synthesized adaptor olignonucleotide
  misc_feature (34)..(36): n is a, c, g, or t
tgcaggaccagagaattcgaatacagatcagctnnntgcatcaggt

SEQ ID NO: 2642 - DNA, 46 bp, Artificial Sequence
  Synthesized adaptor olignonucleotide
  misc_feature (34)..(36): n is a, c, g, or t
tgcaggaccagagaattcgaatacatcgaccttnnntgcatcaggt

SEQ ID NO: 2643 - DNA, 46 bp, Artificial Sequence
  Synthesized adaptor olignonucleotide
  misc_feature (34)..(36): n is a, c, g, or t
tgcaggaccagagaattcgaatacaagcccacgnnntgcatcaggt

SEQ ID NO: 2644 - DNA, 46 bp, Artificial Sequence
  Synthesized adaptor olignonucleotide
  misc_feature (34)..(36): n is a, c, g, or t
tgcaggaccagagaattcgaatacagagatctcnnntgcatcaggt

SEQ ID NO: 2645 - DNA, 46 bp, Artificial Sequence
  Synthesized adaptor olignonucleotide
  misc_feature (34)..(36): n is a, c, g, or t
tgcaggaccagagaattcgaatacatctttaacnnntgcatcaggt

SEQ ID NO: 2646 - DNA, 46 bp, Artificial Sequence
  Synthesized adaptor olignonucleotide
  misc_feature (34)..(36): n is a, c, g, or t
tgcaggaccagagaattcgaatacatccctaacnnntgcatcaggt

SEQ ID NO: 2647 - DNA, 46 bp, Artificial Sequence
  Synthesized adaptor olignonucleotide
  misc_feature (34)..(36): n is a, c, g, or t
tgcaggaccagagaattcgaatacaactcgacannntgcatcaggt

SEQ ID NO: 2648 - DNA, 46 bp, Artificial Sequence
  Synthesized adaptor olignonucleotide
  misc_feature (34)..(36): n is a, c, g, or t
tgcaggaccagagaattcgaatacatgagagacnnntgcatcaggt

SEQ ID NO: 2649 - DNA, 46 bp, Artificial Sequence
  Synthesized adaptor olignonucleotide
  misc_feature (34)..(36): n is a, c, g, or t
tgcaggaccagagaattcgaatacattgagaaannnacgtatgcca

SEQ ID NO: 2650 - DNA, 46 bp, Artificial Sequence
  Synthesized adaptor olignonucleotide
  misc_feature (34)..(36): n is a, c, g, or t
tgcaggaccagagaattcgaatacaaatatccannnacgtatgcca

SEQ ID NO: 2651 - DNA, 46 bp, Artificial Sequence
  Synthesized adaptor olignonucleotide
  misc_feature (34)..(36): n is a, c, g, or t
tgcaggaccagagaattcgaatacaatggacctnnnacgtatgcca

SEQ ID NO: 2652 - DNA, 46 bp, Artificial Sequence
  Synthesized adaptor olignonucleotide
  misc_feature (34)..(36): n is a, c, g, or t
tgcaggaccagagaattcgaatacaggcatactnnnacgtatgcca

SEQ ID NO: 2653 - DNA, 46 bp, Artificial Sequence
  Synthesized adaptor olignonucleotide
  misc_feature (34)..(36): n is a, c, g, or t
tgcaggaccagagaattcgaatacactaaaaagnnnacgtatgcca

SEQ ID NO: 2654 - DNA, 46 bp, Artificial Sequence
  Synthesized adaptor olignonucleotide
  misc_feature (34)..(36): n is a, c, g, or t
tgcaggaccagagaattcgaatacaatacatacnnnacgtatgcca

SEQ ID NO: 2655 - DNA, 46 bp, Artificial Sequence
  Synthesized adaptor olignonucleotide
  misc_feature (34)..(36): n is a, c, g, or t
tgcaggaccagagaattcgaatacatatggccannnacgtatgcca

SEQ ID NO: 2656 - DNA, 46 bp, Artificial Sequence
  Synthesized adaptor olignonucleotide
  misc_feature (34)..(36): n is a, c, g, or t
tgcaggaccagagaattcgaatacaatgatgccnnnacgtatgcca

SEQ ID NO: 2657 - DNA, 46 bp, Artificial Sequence
  Synthesized adaptor olignonucleotide
  misc_feature (34)..(36): n is a, c, g, or t
tgcaggaccagagaattcgaatacaaggtaggtnnnacgtatgcca

SEQ ID NO: 2658 - DNA, 46 bp, Artificial Sequence
  Synthesized adaptor olignonucleotide
  misc_feature (34)..(36): n is a, c, g, or t
tgcaggaccagagaattcgaatacatccctagtnnnacgtatgcca

SEQ ID NO: 2659 - DNA, 46 bp, Artificial Sequence
  Synthesized adaptor olignonucleotide
  misc_feature (34)..(36): n is a, c, g, or t
tgcaggaccagagaattcgaatacagtatttgannnacgtatgcca

SEQ ID NO: 2660 - DNA, 46 bp, Artificial Sequence
  Synthesized adaptor olignonucleotide
  misc_feature (34)..(36): n is a, c, g, or t
tgcaggaccagagaattcgaatacaagtgaatannnacgtatgcca

SEQ ID NO: 2661 - DNA, 46 bp, Artificial Sequence
  Synthesized adaptor olignonucleotide
  misc_feature (34)..(36): n is a, c, g, or t
tgcaggaccagagaattcgaatacaaatcgcacnnnacgtatgcca

SEQ ID NO: 2662 - DNA, 46 bp, Artificial Sequence
  Synthesized adaptor olignonucleotide
  misc_feature (34)..(36): n is a, c, g, or t
tgcaggaccagagaattcgaatacagtcccccannnacgtatgcca

SEQ ID NO: 2663 - DNA, 46 bp, Artificial Sequence
  Synthesized adaptor olignonucleotide
  misc_feature (34)..(36): n is a, c, g, or t
tgcaggaccagagaattcgaatacagcccactcnnnacgtatgcca

SEQ ID NO: 2664 - DNA, 46 bp, Artificial Sequence
  Synthesized adaptor olignonucleotide
  misc_feature (34)..(36): n is a, c, g, or t
tgcaggaccagagaattcgaatacagagatatannnacgtatgcca

SEQ ID NO: 2665 - DNA, 46 bp, Artificial Sequence
  Synthesized adaptor olignonucleotide
  misc_feature (34)..(36): n is a, c, g, or t
tgcaggaccagagaattcgaatacagcactacannnacgtatgcca

SEQ ID NO: 2666 - DNA, 46 bp, Artificial Sequence
  Synthesized adaptor olignonucleotide
  misc_feature (34)..(36): n is a, c, g, or t
tgcaggaccagagaattcgaatacaactttgccnnnacgtatgcca

SEQ ID NO: 2667 - DNA, 46 bp, Artificial Sequence
  Synthesized adaptor olignonucleotide
  misc_feature (34)..(36): n is a, c, g, or t
tgcaggaccagagaattcgaatacactgaggccnnnacgtatgcca

SEQ ID NO: 2668 - DNA, 46 bp, Artificial Sequence
  Synthesized adaptor olignonucleotide
  misc_feature (34)..(36): n is a, c, g, or t
tgcaggaccagagaattcgaatacaaagtaggcnnnacgtatgcca

SEQ ID NO: 2669 - DNA, 46 bp, Artificial Sequence
  Synthesized adaptor olignonucleotide
  misc_feature (34)..(36): n is a, c, g, or t
tgcaggaccagagaattcgaatacagcttctacnnnacgtatgcca

SEQ ID NO: 2670 - DNA, 46 bp, Artificial Sequence
  Synthesized adaptor olignonucleotide
  misc_feature (34)..(36): n is a, c, g, or t
tgcaggaccagagaattcgaatacatggaggatnnnacgtatgcca

SEQ ID NO: 2671 - DNA, 46 bp, Artificial Sequence
  Synthesized adaptor olignonucleotide
  misc_feature (34)..(36): n is a, c, g, or t
tgcaggaccagagaattcgaatacagctaaccannnacgtatgcca

SEQ ID NO: 2672 - DNA, 46 bp, Artificial Sequence
  Synthesized adaptor olignonucleotide
  misc_feature (34)..(36): n is a, c, g, or t
tgcaggaccagagaattcgaatacaacccttacnnnacgtatgcca

SEQ ID NO: 2673 - DNA, 46 bp, Artificial Sequence
  Synthesized adaptor olignonucleotide
  misc_feature (34)..(36): n is a, c, g, or t
tgcaggaccagagaattcgaatacagtcttctgnnnacgtatgcca

SEQ ID NO: 2674 - DNA, 46 bp, Artificial Sequence
  Synthesized adaptor olignonucleotide
  misc_feature (34)..(36): n is a, c, g, or t
tgcaggaccagagaattcgaatacacggagcctnnnacgtatgcca

SEQ ID NO: 2675 - DNA, 46 bp, Artificial Sequence
  Synthesized adaptor olignonucleotide
  misc_feature (34)..(36): n is a, c, g, or t
tgcaggaccagagaattcgaatacacctgatgannnacgtatgcca

SEQ ID NO: 2676 - DNA, 46 bp, Artificial Sequence
  Synthesized adaptor olignonucleotide
  misc_feature (34)..(36): n is a, c, g, or t
tgcaggaccagagaattcgaatacatcgatacgnnnacgtatgcca

SEQ ID NO: 2677 - DNA, 46 bp, Artificial Sequence
  Synthesized adaptor olignonucleotide
  misc_feature (34)..(36): n is a, c, g, or t
tgcaggaccagagaattcgaatacaaagaatgtnnnacgtatgcca

SEQ ID NO: 2678 - DNA, 46 bp, Artificial Sequence
  Synthesized adaptor olignonucleotide
  misc_feature (34)..(36): n is a, c, g, or t
tgcaggaccagagaattcgaatacatgcgctccnnnacgtatgcca

SEQ ID NO: 2679 - DNA, 46 bp, Artificial Sequence
  Synthesized adaptor olignonucleotide
  misc_feature (34)..(36): n is a, c, g, or t
tgcaggaccagagaattcgaatacaaagtcattnnnacgtatgcca

SEQ ID NO: 2680 - DNA, 46 bp, Artificial Sequence
  Synthesized adaptor olignonucleotide
  misc_feature (34)..(36): n is a, c, g, or t
tgcaggaccagagaattcgaatacatgtaatgtnnnacgtatgcca

SEQ ID NO: 2681 - DNA, 46 bp, Artificial Sequence
  Synthesized adaptor olignonucleotide
  misc_feature (34)..(36): n is a, c, g, or t
tgcaggaccagagaattcgaatacaatctacccnnnacgtatgcca

SEQ ID NO: 2682 - DNA, 46 bp, Artificial Sequence
  Synthesized adaptor olignonucleotide
  misc_feature (34)..(36): n is a, c, g, or t
tgcaggaccagagaattcgaatacatgccacaannnacgtatgcca

SEQ ID NO: 2683 - DNA, 46 bp, Artificial Sequence
  Synthesized adaptor olignonucleotide
  misc_feature (34)..(36): n is a, c, g, or t
tgcaggaccagagaattcgaatacagagtgttcnnnacgtatgcca

SEQ ID NO: 2684 - DNA, 46 bp, Artificial Sequence
  Synthesized adaptor olignonucleotide
  misc_feature (34)..(36): n is a, c, g, or t
tgcaggaccagagaattcgaatacaaacagcctnnnacgtatgcca

SEQ ID NO: 2685 - DNA, 46 bp, Artificial Sequence
  Synthesized adaptor olignonucleotide
  misc_feature (34)..(36): n is a, c, g, or t
tgcaggaccagagaattcgaatacaggacgacgnnnacgtatgcca

SEQ ID NO: 2686 - DNA, 46 bp, Artificial Sequence
  Synthesized adaptor olignonucleotide
  misc_feature (34)..(36): n is a, c, g, or t
tgcaggaccagagaattcgaatacaattccggannnacgtatgcca

SEQ ID NO: 2687 - DNA, 46 bp, Artificial Sequence
  Synthesized adaptor olignonucleotide
  misc_feature (34)..(36): n is a, c, g, or t
tgcaggaccagagaattcgaatacaggtctcaannnacgtatgcca

SEQ ID NO: 2688 - DNA, 46 bp, Artificial Sequence
  Synthesized adaptor olignonucleotide
  misc_feature (34)..(36): n is a, c, g, or t
tgcaggaccagagaattcgaatacacaccatgannnacgtatgcca

SEQ ID NO: 2689 - DNA, 46 bp, Artificial Sequence
  Synthesized adaptor olignonucleotide
  misc_feature (34)..(36): n is a, c, g, or t
tgcaggaccagagaattcgaatacacaaacggannnacgtatgcca

SEQ ID NO: 2690 - DNA, 46 bp, Artificial Sequence
  Synthesized adaptor olignonucleotide
  misc_feature (34)..(36): n is a, c, g, or t
tgcaggaccagagaattcgaatacaagagcgtannnacgtatgcca

SEQ ID NO: 2691 - DNA, 46 bp, Artificial Sequence
  Synthesized adaptor olignonucleotide
  misc_feature (34)..(36): n is a, c, g, or t
tgcaggaccagagaattcgaatacacccctgacnnnacgtatgcca

SEQ ID NO: 2692 - DNA, 46 bp, Artificial Sequence
  Synthesized adaptor olignonucleotide
  misc_feature (34)..(36): n is a, c, g, or t
tgcaggaccagagaattcgaatacaccaagttgnnnacgtatgcca

SEQ ID NO: 2693 - DNA, 46 bp, Artificial Sequence
  Synthesized adaptor olignonucleotide
  misc_feature (34)..(36): n is a, c, g, or t
tgcaggaccagagaattcgaatacatgtgtaatnnnacgtatgcca

SEQ ID NO: 2694 - DNA, 46 bp, Artificial Sequence
  Synthesized adaptor olignonucleotide
  misc_feature (34)..(36): n is a, c, g, or t
tgcaggaccagagaattcgaatacaatttgtgannnacgtatgcca

SEQ ID NO: 2695 - DNA, 46 bp, Artificial Sequence
  Synthesized adaptor olignonucleotide
  misc_feature (34)..(36): n is a, c, g, or t
tgcaggaccagagaattcgaatacagtagcgttnnnacgtatgcca

SEQ ID NO: 2696 - DNA, 46 bp, Artificial Sequence
  Synthesized adaptor olignonucleotide
  misc_feature (34)..(36): n is a, c, g, or t
tgcaggaccagagaattcgaatacacacgtgatnnnacgtatgcca

SEQ ID NO: 2697 - DNA, 46 bp, Artificial Sequence
  Synthesized adaptor olignonucleotide
  misc_feature (34)..(36): n is a, c, g, or t
tgcaggaccagagaattcgaatacaaacagcgannnacgtatgcca

SEQ ID NO: 2698 - DNA, 46 bp, Artificial Sequence
  Synthesized adaptor olignonucleotide
  misc_feature (34)..(36): n is a, c, g, or t
tgcaggaccagagaattcgaatacaaaatgcggnnnacgtatgcca

SEQ ID NO: 2699 - DNA, 46 bp, Artificial Sequence
  Synthesized adaptor olignonucleotide
  misc_feature (34)..(36): n is a, c, g, or t
tgcaggaccagagaattcgaatacataccaagcnnnacgtatgcca

SEQ ID NO: 2700 - DNA, 46 bp, Artificial Sequence
  Synthesized adaptor olignonucleotide
  misc_feature (34)..(36): n is a, c, g, or t
tgcaggaccagagaattcgaatacacgaccctcnnnacgtatgcca

SEQ ID NO: 2701 - DNA, 46 bp, Artificial Sequence
  Synthesized adaptor olignonucleotide
  misc_feature (34)..(36): n is a, c, g, or t
tgcaggaccagagaattcgaatacaacacccttnnnacgtatgcca

SEQ ID NO: 2702 - DNA, 46 bp, Artificial Sequence
  Synthesized adaptor olignonucleotide
  misc_feature (34)..(36): n is a, c, g, or t
tgcaggaccagagaattcgaatacactgtcgccnnnacgtatgcca

SEQ ID NO: 2703 - DNA, 46 bp, Artificial Sequence
  Synthesized adaptor olignonucleotide
  misc_feature (34)..(36): n is a, c, g, or t
tgcaggaccagagaattcgaatacaagccgccannnacgtatgcca

SEQ ID NO: 2704 - DNA, 46 bp, Artificial Sequence
  Synthesized adaptor olignonucleotide
  misc_feature (34)..(36): n is a, c, g, or t
tgcaggaccagagaattcgaatacatgtacaatnnnacgtatgcca

SEQ ID NO: 2705 - DNA, 46 bp, Artificial Sequence
  Synthesized adaptor olignonucleotide
  misc_feature (34)..(36): n is a, c, g, or t
tgcaggaccagagaattcgaatacagatctacgnnnacgtatgcca

SEQ ID NO: 2706 - DNA, 46 bp, Artificial Sequence
  Synthesized adaptor olignonucleotide
  misc_feature (34)..(36): n is a, c, g, or t
tgcaggaccagagaattcgaatacaccagtcttnnnacgtatgcca

SEQ ID NO: 2707 - DNA, 46 bp, Artificial Sequence
  Synthesized adaptor olignonucleotide
  misc_feature (34)..(36): n is a, c, g, or t
tgcaggaccagagaattcgaatacagctgcaatnnnacgtatgcca

SEQ ID NO: 2708 - DNA, 46 bp, Artificial Sequence
  Synthesized adaptor olignonucleotide
  misc_feature (34)..(36): n is a, c, g, or t
tgcaggaccagagaattcgaatacagaagagtcnnnacgtatgcca

SEQ ID NO: 2709 - DNA, 46 bp, Artificial Sequence
  Synthesized adaptor olignonucleotide
  misc_feature (34)..(36): n is a, c, g, or t
tgcaggaccagagaattcgaatacaacaactcgnnnctagcgttac

SEQ ID NO: 2710 - DNA, 46 bp, Artificial Sequence
  Synthesized adaptor olignonucleotide
  misc_feature (34)..(36): n is a, c, g, or t
tgcaggaccagagaattcgaatacatgcgcaatnnnctagcgttac

SEQ ID NO: 2711 - DNA, 46 bp, Artificial Sequence
  Synthesized adaptor olignonucleotide
  misc_feature (34)..(36): n is a, c, g, or t
tgcaggaccagagaattcgaatacataagaacannnctagcgttac

SEQ ID NO: 2712 - DNA, 46 bp, Artificial Sequence
  Synthesized adaptor olignonucleotide
  misc_feature (34)..(36): n is a, c, g, or t
tgcaggaccagagaattcgaatacacgcttgccnnnctagcgttac

SEQ ID NO: 2713 - DNA, 46 bp, Artificial Sequence
  Synthesized adaptor olignonucleotide
  misc_feature (34)..(36): n is a, c, g, or t
tgcaggaccagagaattcgaatacattacacggnnnctagcgttac

SEQ ID NO: 2714 - DNA, 46 bp, Artificial Sequence
  Synthesized adaptor olignonucleotide
  misc_feature (34)..(36): n is a, c, g, or t
tgcaggaccagagaattcgaatacactccaccgnnnctagcgttac

SEQ ID NO: 2715 - DNA, 46 bp, Artificial Sequence
  Synthesized adaptor olignonucleotide
  misc_feature (34)..(36): n is a, c, g, or t
tgcaggaccagagaattcgaatacacgacccagnnnctagcgttac

SEQ ID NO: 2716 - DNA, 46 bp, Artificial Sequence
  Synthesized adaptor olignonucleotide
  misc_feature (34)..(36): n is a, c, g, or t
tgcaggaccagagaattcgaatacacggtcagcnnnctagcgttac

SEQ ID NO: 2717 - DNA, 46 bp, Artificial Sequence
  Synthesized adaptor olignonucleotide
  misc_feature (34)..(36): n is a, c, g, or t
tgcaggaccagagaattcgaatacacactatccnnnctagcgttac

SEQ ID NO: 2718 - DNA, 46 bp, Artificial Sequence
  Synthesized adaptor olignonucleotide
  misc_feature (34)..(36): n is a, c, g, or t
tgcaggaccagagaattcgaatacactagtctcnnnctagcgttac

SEQ ID NO: 2719 - DNA, 46 bp, Artificial Sequence
  Synthesized adaptor olignonucleotide
  misc_feature (34)..(36): n is a, c, g, or t
tgcaggaccagagaattcgaatacataccttcgnnnctagcgttac

SEQ ID NO: 2720 - DNA, 46 bp, Artificial Sequence
  Synthesized adaptor olignonucleotide
  misc_feature (34)..(36): n is a, c, g, or t
tgcaggaccagagaattcgaatacaaaccagagnnnctagcgttac

SEQ ID NO: 2721 - DNA, 46 bp, Artificial Sequence
  Synthesized adaptor olignonucleotide
  misc_feature (34)..(36): n is a, c, g, or t
tgcaggaccagagaattcgaatacatgactcgannnctagcgttac

SEQ ID NO: 2722 - DNA, 46 bp, Artificial Sequence
  Synthesized adaptor olignonucleotide
  misc_feature (34)..(36): n is a, c, g, or t
tgcaggaccagagaattcgaatacaacccagatnnnctagcgttac

SEQ ID NO: 2723 - DNA, 46 bp, Artificial Sequence
  Synthesized adaptor olignonucleotide
  misc_feature (34)..(36): n is a, c, g, or t
tgcaggaccagagaattcgaatacatgcgctttnnnctagcgttac

SEQ ID NO: 2724 - DNA, 46 bp, Artificial Sequence
  Synthesized adaptor olignonucleotide
  misc_feature (34)..(36): n is a, c, g, or t
tgcaggaccagagaattcgaatacaggaggaccnnnctagcgttac

SEQ ID NO: 2725 - DNA, 46 bp, Artificial Sequence
  Synthesized adaptor olignonucleotide
  misc_feature (34)..(36): n is a, c, g, or t
tgcaggaccagagaattcgaatacatcgtccatnnnctagcgttac

SEQ ID NO: 2726 - DNA, 46 bp, Artificial Sequence
  Synthesized adaptor olignonucleotide
  misc_feature (34)..(36): n is a, c, g, or t
tgcaggaccagagaattcgaatacacgacctccnnnctagcgttac

SEQ ID NO: 2727 - DNA, 46 bp, Artificial Sequence
  Synthesized adaptor olignonucleotide
  misc_feature (34)..(36): n is a, c, g, or t
tgcaggaccagagaattcgaatacaagattccgnnnctagcgttac

SEQ ID NO: 2728 - DNA, 46 bp, Artificial Sequence
  Synthesized adaptor olignonucleotide
  misc_feature (34)..(36): n is a, c, g, or t
tgcaggaccagagaattcgaatacaactcgaacnnnctagcgttac

SEQ ID NO: 2729 - DNA, 46 bp, Artificial Sequence
  Synthesized adaptor olignonucleotide
  misc_feature (34)..(36): n is a, c, g, or t
tgcaggaccagagaattcgaatacaagacgatgnnnctagcgttac

SEQ ID NO: 2730 - DNA, 46 bp, Artificial Sequence
  Synthesized adaptor olignonucleotide
  misc_feature (34)..(36): n is a, c, g, or t
tgcaggaccagagaattcgaatacagaacttatnnnctagcgttac

SEQ ID NO: 2731 - DNA, 46 bp, Artificial Sequence
  Synthesized adaptor olignonucleotide
  misc_feature (34)..(36): n is a, c, g, or t
tgcaggaccagagaattcgaatacaaccagcgcnnnctagcgttac

SEQ ID NO: 2732 - DNA, 46 bp, Artificial Sequence
  Synthesized adaptor olignonucleotide
  misc_feature (34)..(36): n is a, c, g, or t
tgcaggaccagagaattcgaatacatacctctgnnnctagcgttac

SEQ ID NO: 2733 - DNA, 46 bp, Artificial Sequence
  Synthesized adaptor olignonucleotide
  misc_feature (34)..(36): n is a, c, g, or t
tgcaggaccagagaattcgaatacacggagcgannnctagcgttac

SEQ ID NO: 2734 - DNA, 46 bp, Artificial Sequence
  Synthesized adaptor olignonucleotide
  misc_feature (34)..(36): n is a, c, g, or t
tgcaggaccagagaattcgaatacaaccggaaannnctagcgttac

SEQ ID NO: 2735 - DNA, 46 bp, Artificial Sequence
  Synthesized adaptor olignonucleotide
  misc_feature (34)..(36): n is a, c, g, or t
tgcaggaccagagaattcgaatacaggatcgccnnnctagcgttac

SEQ ID NO: 2736 - DNA, 46 bp, Artificial Sequence
  Synthesized adaptor olignonucleotide
  misc_feature (34)..(36): n is a, c, g, or t
tgcaggaccagagaattcgaatacaatcagcacnnnctagcgttac

SEQ ID NO: 2737 - DNA, 46 bp, Artificial Sequence
  Synthesized adaptor olignonucleotide
  misc_feature (34)..(36): n is a, c, g, or t
tgcaggaccagagaattcgaatacaaactctccnnnctagcgttac

SEQ ID NO: 2738 - DNA, 46 bp, Artificial Sequence
  Synthesized adaptor olignonucleotide
  misc_feature (34)..(36): n is a, c, g, or t
tgcaggaccagagaattcgaatacatatgagttnnnctagcgttac

SEQ ID NO: 2739 - DNA, 46 bp, Artificial Sequence
  Synthesized adaptor olignonucleotide
  misc_feature (34)..(36): n is a, c, g, or t
tgcaggaccagagaattcgaatacaaggcgtccnnnctagcgttac

SEQ ID NO: 2740 - DNA, 46 bp, Artificial Sequence
  Synthesized adaptor olignonucleotide
  misc_feature (34)..(36): n is a, c, g, or t
tgcaggaccagagaattcgaatacaagaattagnnnctagcgttac

SEQ ID NO: 2741 - DNA, 46 bp, Artificial Sequence
  Synthesized adaptor olignonucleotide
  misc_feature (34)..(36): n is a, c, g, or t
tgcaggaccagagaattcgaatacagatttagtnnnctagcgttac

SEQ ID NO: 2742 - DNA, 46 bp, Artificial Sequence
  Synthesized adaptor olignonucleotide
  misc_feature (34)..(36): n is a, c, g, or t
tgcaggaccagagaattcgaatacatatttctgnnnctagcgttac

SEQ ID NO: 2743 - DNA, 46 bp, Artificial Sequence
  Synthesized adaptor olignonucleotide
  misc_feature (34)..(36): n is a, c, g, or t
tgcaggaccagagaattcgaatacagctgtacannnctagcgttac

SEQ ID NO: 2744 - DNA, 46 bp, Artificial Sequence
  Synthesized adaptor olignonucleotide
  misc_feature (34)..(36): n is a, c, g, or t
tgcaggaccagagaattcgaatacagcttacgannnctagcgttac

SEQ ID NO: 2745 - DNA, 46 bp, Artificial Sequence
  Synthesized adaptor olignonucleotide
  misc_feature (34)..(36): n is a, c, g, or t
tgcaggaccagagaattcgaatacacccacggannnctagcgttac

SEQ ID NO: 2746 - DNA, 46 bp, Artificial Sequence
  Synthesized adaptor olignonucleotide
  misc_feature (34)..(36): n is a, c, g, or t
tgcaggaccagagaattcgaatacatggatctgnnnctagcgttac

SEQ ID NO: 2747 - DNA, 46 bp, Artificial Sequence
  Synthesized adaptor olignonucleotide
  misc_feature (34)..(36): n is a, c, g, or t
tgcaggaccagagaattcgaatacatccacgaannnctagcgttac

SEQ ID NO: 2748 - DNA, 46 bp, Artificial Sequence
  Synthesized adaptor olignonucleotide
  misc_feature (34)..(36): n is a, c, g, or t
tgcaggaccagagaattcgaatacatcaagaccnnnctagcgttac

SEQ ID NO: 2749 - DNA, 46 bp, Artificial Sequence
  Synthesized adaptor olignonucleotide
  misc_feature (34)..(36): n is a, c, g, or t
tgcaggaccagagaattcgaatacaggcagacgnnnctagcgttac

SEQ ID NO: 2750 - DNA, 46 bp, Artificial Sequence
  Synthesized adaptor olignonucleotide
  misc_feature (34)..(36): n is a, c, g, or t
tgcaggaccagagaattcgaatacatttttacgnnnctagcgttac

SEQ ID NO: 2751 - DNA, 46 bp, Artificial Sequence
  Synthesized adaptor olignonucleotide
  misc_feature (34)..(36): n is a, c, g, or t
tgcaggaccagagaattcgaatacagcgtttgannnctagcgttac

SEQ ID NO: 2752 - DNA, 46 bp, Artificial Sequence
  Synthesized adaptor olignonucleotide
  misc_feature (34)..(36): n is a, c, g, or t
tgcaggaccagagaattcgaatacaaggtactcnnnctagcgttac

SEQ ID NO: 2753 - DNA, 46 bp, Artificial Sequence
  Synthesized adaptor olignonucleotide
  misc_feature (34)..(36): n is a, c, g, or t
tgcaggaccagagaattcgaatacattctgttannnctagcgttac

SEQ ID NO: 2754 - DNA, 46 bp, Artificial Sequence
  Synthesized adaptor olignonucleotide
  misc_feature (34)..(36): n is a, c, g, or t
tgcaggaccagagaattcgaatacaccgatgtannnctagcgttac

SEQ ID NO: 2755 - DNA, 46 bp, Artificial Sequence
  Synthesized adaptor olignonucleotide
  misc_feature (34)..(36): n is a, c, g, or t
tgcaggaccagagaattcgaatacagtcggttannnctagcgttac

SEQ ID NO: 2756 - DNA, 46 bp, Artificial Sequence
  Synthesized adaptor olignonucleotide
  misc_feature (34)..(36): n is a, c, g, or t
tgcaggaccagagaattcgaatacacgaacccgnnnctagcgttac

SEQ ID NO: 2757 - DNA, 46 bp, Artificial Sequence
  Synthesized adaptor olignonucleotide
  misc_feature (34)..(36): n is a, c, g, or t
tgcaggaccagagaattcgaatacattcgactcnnnctagcgttac

SEQ ID NO: 2758 - DNA, 46 bp, Artificial Sequence
  Synthesized adaptor olignonucleotide
  misc_feature (34)..(36): n is a, c, g, or t
tgcaggaccagagaattcgaatacattcagcctnnnctagcgttac

SEQ ID NO: 2759 - DNA, 46 bp, Artificial Sequence
  Synthesized adaptor olignonucleotide
  misc_feature (34)..(36): n is a, c, g, or t
tgcaggaccagagaattcgaatacacacttgagnnnctagcgttac

SEQ ID NO: 2760 - DNA, 46 bp, Artificial Sequence
  Synthesized adaptor olignonucleotide
  misc_feature (34)..(36): n is a, c, g, or t
tgcaggaccagagaattcgaatacatcacgcggnnnctagcgttac

SEQ ID NO: 2761 - DNA, 46 bp, Artificial Sequence
  Synthesized adaptor olignonucleotide
  misc_feature (34)..(36): n is a, c, g, or t
tgcaggaccagagaattcgaatacacactgtagnnnctagcgttac

SEQ ID NO: 2762 - DNA, 46 bp, Artificial Sequence
  Synthesized adaptor olignonucleotide
  misc_feature (34)..(36): n is a, c, g, or t
tgcaggaccagagaattcgaatacaaccaagctnnnctagcgttac

SEQ ID NO: 2763 - DNA, 46 bp, Artificial Sequence
  Synthesized adaptor olignonucleotide
  misc_feature (34)..(36): n is a, c, g, or t
tgcaggaccagagaattcgaatacaactgcaacnnnctagcgttac

SEQ ID NO: 2764 - DNA, 46 bp, Artificial Sequence
  Synthesized adaptor olignonucleotide
  misc_feature (34)..(36): n is a, c, g, or t
tgcaggaccagagaattcgaatacataacggtcnnnctagcgttac

SEQ ID NO: 2765 - DNA, 46 bp, Artificial Sequence
  Synthesized adaptor olignonucleotide
  misc_feature (34)..(36): n is a, c, g, or t
tgcaggaccagagaattcgaatacaagtttgtannnctagcgttac

SEQ ID NO: 2766 - DNA, 46 bp, Artificial Sequence
  Synthesized adaptor olignonucleotide
  misc_feature (34)..(36): n is a, c, g, or t
tgcaggaccagagaattcgaatacacacgtttcnnnctagcgttac

SEQ ID NO: 2767 - DNA, 46 bp, Artificial Sequence
  Synthesized adaptor olignonucleotide
  misc_feature (34)..(36): n is a, c, g, or t
tgcaggaccagagaattcgaatacattaaaaccnnnctagcgttac

SEQ ID NO: 2768 - DNA, 46 bp, Artificial Sequence
  Synthesized adaptor olignonucleotide
  misc_feature (34)..(36): n is a, c, g, or t
tgcaggaccagagaattcgaatacattcgtaggnnnctagcgttac

SEQ ID NO: 2769 - DNA, 46 bp, Artificial Sequence
  Synthesized adaptor olignonucleotide
  misc_feature (34)..(36): n is a, c, g, or t
tgcaggaccagagaattcgaatacatgcgtagtnnngatcgacatg

SEQ ID NO: 2770 - DNA, 46 bp, Artificial Sequence
  Synthesized adaptor olignonucleotide
  misc_feature (34)..(36): n is a, c, g, or t
tgcaggaccagagaattcgaatacagctttgctnnngatcgacatg

SEQ ID NO: 2771 - DNA, 46 bp, Artificial Sequence
  Synthesized adaptor olignonucleotide
  misc_feature (34)..(36): n is a, c, g, or t
tgcaggaccagagaattcgaatacagtaaatagnnngatcgacatg

SEQ ID NO: 2772 - DNA, 46 bp, Artificial Sequence
  Synthesized adaptor olignonucleotide
  misc_feature (34)..(36): n is a, c, g, or t
tgcaggaccagagaattcgaatacacgctgtccnnngatcgacatg

SEQ ID NO: 2773 - DNA, 46 bp, Artificial Sequence
  Synthesized adaptor olignonucleotide
  misc_feature (34)..(36): n is a, c, g, or t
tgcaggaccagagaattcgaatacacttagagcnnngatcgacatg

SEQ ID NO: 2774 - DNA, 46 bp, Artificial Sequence
  Synthesized adaptor olignonucleotide
  misc_feature (34)..(36): n is a, c, g, or t
tgcaggaccagagaattcgaatacaggacatagnnngatcgacatg

SEQ ID NO: 2775 - DNA, 46 bp, Artificial Sequence
  Synthesized adaptor olignonucleotide
  misc_feature (34)..(36): n is a, c, g, or t
tgcaggaccagagaattcgaatacatctacaggnnngatcgacatg

SEQ ID NO: 2776 - DNA, 46 bp, Artificial Sequence
  Synthesized adaptor olignonucleotide
  misc_feature (34)..(36): n is a, c, g, or t
tgcaggaccagagaattcgaatacacaaactcgnnngatcgacatg

SEQ ID NO: 2777 - DNA, 46 bp, Artificial Sequence
  Synthesized adaptor olignonucleotide
  misc_feature (34)..(36): n is a, c, g, or t
tgcaggaccagagaattcgaatacagctattccnnngatcgacatg

SEQ ID NO: 2778 - DNA, 46 bp, Artificial Sequence
  Synthesized adaptor olignonucleotide
  misc_feature (34)..(36): n is a, c, g, or t
tgcaggaccagagaattcgaatacagtccagtannngatcgacatg

SEQ ID NO: 2779 - DNA, 46 bp, Artificial Sequence
  Synthesized adaptor olignonucleotide
  misc_feature (34)..(36): n is a, c, g, or t
tgcaggaccagagaattcgaatacaggcgagacnnngatcgacatg

SEQ ID NO: 2780 - DNA, 46 bp, Artificial Sequence
  Synthesized adaptor olignonucleotide
  misc_feature (34)..(36): n is a, c, g, or t
tgcaggaccagagaattcgaatacatttcatacnnngatcgacatg

SEQ ID NO: 2781 - DNA, 46 bp, Artificial Sequence
  Synthesized adaptor olignonucleotide
  misc_feature (34)..(36): n is a, c, g, or t
tgcaggaccagagaattcgaatacacagctgtannngatcgacatg

SEQ ID NO: 2782 - DNA, 46 bp, Artificial Sequence
  Synthesized adaptor olignonucleotide
  misc_feature (34)..(36): n is a, c, g, or t
tgcaggaccagagaattcgaatacaactgctctnnngatcgacatg

SEQ ID NO: 2783 - DNA, 46 bp, Artificial Sequence
  Synthesized adaptor olignonucleotide
  misc_feature (34)..(36): n is a, c, g, or t
tgcaggaccagagaattcgaatacaaaagttctnnngatcgacatg

SEQ ID NO: 2784 - DNA, 46 bp, Artificial Sequence
  Synthesized adaptor olignonucleotide
  misc_feature (34)..(36): n is a, c, g, or t
tgcaggaccagagaattcgaatacagaatcgagnnngatcgacatg

SEQ ID NO: 2785 - DNA, 46 bp, Artificial Sequence
  Synthesized adaptor olignonucleotide
  misc_feature (34)..(36): n is a, c, g, or t
tgcaggaccagagaattcgaatacactcccgcannngatcgacatg

SEQ ID NO: 2786 - DNA, 46 bp, Artificial Sequence
  Synthesized adaptor olignonucleotide
  misc_feature (34)..(36): n is a, c, g, or t
tgcaggaccagagaattcgaatacagaaaactannngatcgacatg

SEQ ID NO: 2787 - DNA, 46 bp, Artificial Sequence
  Synthesized adaptor olignonucleotide
  misc_feature (34)..(36): n is a, c, g, or t
tgcaggaccagagaattcgaatacaaccctaagnnngatcgacatg

SEQ ID NO: 2788 - DNA, 46 bp, Artificial Sequence
  Synthesized adaptor olignonucleotide
  misc_feature (34)..(36): n is a, c, g, or t
tgcaggaccagagaattcgaatacaggtcatacnnngatcgacatg

SEQ ID NO: 2789 - DNA, 46 bp, Artificial Sequence
  Synthesized adaptor olignonucleotide
  misc_feature (34)..(36): n is a, c, g, or t
tgcaggaccagagaattcgaatacatggttgtgnnngatcgacatg

SEQ ID NO: 2790 - DNA, 46 bp, Artificial Sequence
  Synthesized adaptor olignonucleotide
  misc_feature (34)..(36): n is a, c, g, or t
tgcaggaccagagaattcgaatacaaagttccgnnngatcgacatg

SEQ ID NO: 2791 - DNA, 46 bp, Artificial Sequence
  Synthesized adaptor olignonucleotide
  misc_feature (34)..(36): n is a, c, g, or t
tgcaggaccagagaattcgaatacaatcaatgtnnngatcgacatg

SEQ ID NO: 2792 - DNA, 46 bp, Artificial Sequence
  Synthesized adaptor olignonucleotide
  misc_feature (34)..(36): n is a, c, g, or t
tgcaggaccagagaattcgaatacacattgatannngatcgacatg

SEQ ID NO: 2793 - DNA, 46 bp, Artificial Sequence
  Synthesized adaptor olignonucleotide
  misc_feature (34)..(36): n is a, c, g, or t
tgcaggaccagagaattcgaatacaggaggaaannngatcgacatg

SEQ ID NO: 2794 - DNA, 46 bp, Artificial Sequence
  Synthesized adaptor olignonucleotide
  misc_feature (34)..(36): n is a, c, g, or t
tgcaggaccagagaattcgaatacacattttacnnngatcgacatg

SEQ ID NO: 2795 - DNA, 46 bp, Artificial Sequence
  Synthesized adaptor olignonucleotide
  misc_feature (34)..(36): n is a, c, g, or t
tgcaggaccagagaattcgaatacagaacttcgnnngatcgacatg

SEQ ID NO: 2796 - DNA, 46 bp, Artificial Sequence
  Synthesized adaptor olignonucleotide
  misc_feature (34)..(36): n is a, c, g, or t
tgcaggaccagagaattcgaatacacgtcacccnnngatcgacatg

SEQ ID NO: 2797 - DNA, 46 bp, Artificial Sequence
  Synthesized adaptor olignonucleotide
  misc_feature (34)..(36): n is a, c, g, or t
tgcaggaccagagaattcgaatacaacgttaatnnngatcgacatg

SEQ ID NO: 2798 - DNA, 46 bp, Artificial Sequence
  Synthesized adaptor olignonucleotide
  misc_feature (34)..(36): n is a, c, g, or t
tgcaggaccagagaattcgaatacaggtgtgttnnngatcgacatg

SEQ ID NO: 2799 - DNA, 46 bp, Artificial Sequence
  Synthesized adaptor olignonucleotide
  misc_feature (34)..(36): n is a, c, g, or t
tgcaggaccagagaattcgaatacagaaatagtnnngatcgacatg

SEQ ID NO: 2800 - DNA, 46 bp, Artificial Sequence
  Synthesized adaptor olignonucleotide
  misc_feature (34)..(36): n is a, c, g, or t
tgcaggaccagagaattcgaatacagtctatttnnngatcgacatg

SEQ ID NO: 2801 - DNA, 46 bp, Artificial Sequence
  Synthesized adaptor olignonucleotide
  misc_feature (34)..(36): n is a, c, g, or t
tgcaggaccagagaattcgaatacatagtagccnnngatcgacatg

SEQ ID NO: 2802 - DNA, 46 bp, Artificial Sequence
  Synthesized adaptor olignonucleotide
  misc_feature (34)..(36): n is a, c, g, or t
tgcaggaccagagaattcgaatacagtacaaaannngatcgacatg

SEQ ID NO: 2803 - DNA, 46 bp, Artificial Sequence
  Synthesized adaptor olignonucleotide
  misc_feature (34)..(36): n is a, c, g, or t
tgcaggaccagagaattcgaatacaagagtacgnnngatcgacatg

SEQ ID NO: 2804 - DNA, 46 bp, Artificial Sequence
  Synthesized adaptor olignonucleotide
  misc_feature (34)..(36): n is a, c, g, or t
tgcaggaccagagaattcgaatacatagacttannngatcgacatg

SEQ ID NO: 2805 - DNA, 46 bp, Artificial Sequence
  Synthesized adaptor olignonucleotide
  misc_feature (34)..(36): n is a, c, g, or t
tgcaggaccagagaattcgaatacacgagcaaannngatcgacatg

SEQ ID NO: 2806 - DNA, 46 bp, Artificial Sequence
  Synthesized adaptor olignonucleotide
  misc_feature (34)..(36): n is a, c, g, or t
tgcaggaccagagaattcgaatacaagcgtcgcnnngatcgacatg

SEQ ID NO: 2807 - DNA, 46 bp, Artificial Sequence
  Synthesized adaptor olignonucleotide
  misc_feature (34)..(36): n is a, c, g, or t
tgcaggaccagagaattcgaatacagctggtcgnnngatcgacatg

SEQ ID NO: 2808 - DNA, 46 bp, Artificial Sequence
  Synthesized adaptor olignonucleotide
  misc_feature (34)..(36): n is a, c, g, or t
tgcaggaccagagaattcgaatacaagtccacannngatcgacatg

SEQ ID NO: 2809 - DNA, 46 bp, Artificial Sequence
  Synthesized adaptor olignonucleotide
  misc_feature (34)..(36): n is a, c, g, or t
tgcaggaccagagaattcgaatacatcccttagnnngatcgacatg

SEQ ID NO: 2810 - DNA, 46 bp, Artificial Sequence
  Synthesized adaptor olignonucleotide
  misc_feature (34)..(36): n is a, c, g, or t
tgcaggaccagagaattcgaatacaccggatgcnnngatcgacatg

SEQ ID NO: 2811 - DNA, 46 bp, Artificial Sequence
  Synthesized adaptor olignonucleotide
  misc_feature (34)..(36): n is a, c, g, or t
tgcaggaccagagaattcgaatacatctatatcnnngatcgacatg

SEQ ID NO: 2812 - DNA, 46 bp, Artificial Sequence
  Synthesized adaptor olignonucleotide
  misc_feature (34)..(36): n is a, c, g, or t
tgcaggaccagagaattcgaatacaagaccctannngatcgacatg

SEQ ID NO: 2813 - DNA, 46 bp, Artificial Sequence
  Synthesized adaptor olignonucleotide
  misc_feature (34)..(36): n is a, c, g, or t
tgcaggaccagagaattcgaatacaggctggtcnnngatcgacatg

SEQ ID NO: 2814 - DNA, 46 bp, Artificial Sequence
  Synthesized adaptor olignonucleotide
  misc_feature (34)..(36): n is a, c, g, or t
tgcaggaccagagaattcgaatacagacgatgannngatcgacatg

SEQ ID NO: 2815 - DNA, 46 bp, Artificial Sequence
  Synthesized adaptor olignonucleotide
  misc_feature (34)..(36): n is a, c, g, or t
tgcaggaccagagaattcgaatacagcccataannngatcgacatg

SEQ ID NO: 2816 - DNA, 46 bp, Artificial Sequence
  Synthesized adaptor olignonucleotide
  misc_feature (34)..(36): n is a, c, g, or t
tgcaggaccagagaattcgaatacaactttcatnnngatcgacatg

SEQ ID NO: 2817 - DNA, 46 bp, Artificial Sequence
  Synthesized adaptor olignonucleotide
  misc_feature (34)..(36): n is a, c, g, or t
tgcaggaccagagaattcgaatacatcgacttcnnngatcgacatg

SEQ ID NO: 2818 - DNA, 46 bp, Artificial Sequence
  Synthesized adaptor olignonucleotide
  misc_feature (34)..(36): n is a, c, g, or t
tgcaggaccagagaattcgaatacacgctacttnnngatcgacatg

SEQ ID NO: 2819 - DNA, 46 bp, Artificial Sequence
  Synthesized adaptor olignonucleotide
  misc_feature (34)..(36): n is a, c, g, or t
tgcaggaccagagaattcgaatacacgaaaacgnnngatcgacatg

SEQ ID NO: 2820 - DNA, 46 bp, Artificial Sequence
  Synthesized adaptor olignonucleotide
  misc_feature (34)..(36): n is a, c, g, or t
tgcaggaccagagaattcgaatacattatggcgnnngatcgacatg

SEQ ID NO: 2821 - DNA, 46 bp, Artificial Sequence
  Synthesized adaptor olignonucleotide
  misc_feature (34)..(36): n is a, c, g, or t
tgcaggaccagagaattcgaatacagctattaannngatcgacatg

SEQ ID NO: 2822 - DNA, 46 bp, Artificial Sequence
  Synthesized adaptor olignonucleotide
  misc_feature (34)..(36): n is a, c, g, or t
tgcaggaccagagaattcgaatacaggcccgcgnnngatcgacatg

SEQ ID NO: 2823 - DNA, 46 bp, Artificial Sequence
  Synthesized adaptor olignonucleotide
  misc_feature (34)..(36): n is a, c, g, or t
tgcaggaccagagaattcgaatacagacgctgcnnngatcgacatg

SEQ ID NO: 2824 - DNA, 46 bp, Artificial Sequence
  Synthesized adaptor olignonucleotide
  misc_feature (34)..(36): n is a, c, g, or t
tgcaggaccagagaattcgaatacaacgagcccnnngatcgacatg

SEQ ID NO: 2825 - DNA, 46 bp, Artificial Sequence
  Synthesized adaptor olignonucleotide
  misc_feature (34)..(36): n is a, c, g, or t
tgcaggaccagagaattcgaatacattcatcgcnnngatcgacatg

SEQ ID NO: 2826 - DNA, 46 bp, Artificial Sequence
  Synthesized adaptor olignonucleotide
  misc_feature (34)..(36): n is a, c, g, or t
tgcaggaccagagaattcgaatacacataaaagnnngatcgacatg

SEQ ID NO: 2827 - DNA, 46 bp, Artificial Sequence
  Synthesized adaptor olignonucleotide
  misc_feature (34)..(36): n is a, c, g, or t
tgcaggaccagagaattcgaatacactcgcgctnnngatcgacatg

SEQ ID NO: 2828 - DNA, 46 bp, Artificial Sequence
  Synthesized adaptor olignonucleotide
  misc_feature (34)..(36): n is a, c, g, or t
tgcaggaccagagaattcgaatacagacatgtcnnngatcgacatg

SEQ ID NO: 2829 - DNA, 46 bp, Artificial Sequence
  Synthesized adaptor olignonucleotide
  misc_feature (34)..(36): n is a, c, g, or t
tgcaggaccagagaattcgaatacactcaccgcnnntgcatcaggt

SEQ ID NO: 2830 - DNA, 46 bp, Artificial Sequence
  Synthesized adaptor olignonucleotide
  misc_feature (34)..(36): n is a, c, g, or t
tgcaggaccagagaattcgaatacacacgtcttnnntgcatcaggt

SEQ ID NO: 2831 - DNA, 46 bp, Artificial Sequence
  Synthesized adaptor olignonucleotide
  misc_feature (34)..(36): n is a, c, g, or t
tgcaggaccagagaattcgaatacaactgcgtannntgcatcaggt

SEQ ID NO: 2832 - DNA, 46 bp, Artificial Sequence
  Synthesized adaptor olignonucleotide
  misc_feature (34)..(36): n is a, c, g, or t
tgcaggaccagagaattcgaatacataaattatnnntgcatcaggt

SEQ ID NO: 2833 - DNA, 46 bp, Artificial Sequence
  Synthesized adaptor olignonucleotide
  misc_feature (34)..(36): n is a, c, g, or t
tgcaggaccagagaattcgaatacatagtctaannntgcatcaggt

SEQ ID NO: 2834 - DNA, 46 bp, Artificial Sequence
  Synthesized adaptor olignonucleotide
  misc_feature (34)..(36): n is a, c, g, or t
tgcaggaccagagaattcgaatacacaaactatnnntgcatcaggt

SEQ ID NO: 2835 - DNA, 46 bp, Artificial Sequence
  Synthesized adaptor olignonucleotide
  misc_feature (34)..(36): n is a, c, g, or t
tgcaggaccagagaattcgaatacatcactgtcnnntgcatcaggt

SEQ ID NO: 2836 - DNA, 46 bp, Artificial Sequence
  Synthesized adaptor olignonucleotide
  misc_feature (34)..(36): n is a, c, g, or t
tgcaggaccagagaattcgaatacaaacaaatgnnntgcatcaggt

SEQ ID NO: 2837 - DNA, 46 bp, Artificial Sequence
  Synthesized adaptor olignonucleotide
  misc_feature (34)..(36): n is a, c, g, or t
tgcaggaccagagaattcgaatacattttcttcnnntgcatcaggt

SEQ ID NO: 2838 - DNA, 46 bp, Artificial Sequence
  Synthesized adaptor olignonucleotide
  misc_feature (34)..(36): n is a, c, g, or t
tgcaggaccagagaattcgaatacacttcagtcnnntgcatcaggt

SEQ ID NO: 2839 - DNA, 46 bp, Artificial Sequence
  Synthesized adaptor olignonucleotide
  misc_feature (34)..(36): n is a, c, g, or t
tgcaggaccagagaattcgaatacaaggtctgtnnntgcatcaggt

SEQ ID NO: 2840 - DNA, 46 bp, Artificial Sequence
  Synthesized adaptor olignonucleotide
  misc_feature (34)..(36): n is a, c, g, or t
tgcaggaccagagaattcgaatacagcaaacagnnntgcatcaggt

SEQ ID NO: 2841 - DNA, 46 bp, Artificial Sequence
  Synthesized adaptor olignonucleotide
  misc_feature (34)..(36): n is a, c, g, or t
tgcaggaccagagaattcgaatacaccgagaggnnntgcatcaggt

SEQ ID NO: 2842 - DNA, 46 bp, Artificial Sequence
  Synthesized adaptor olignonucleotide
  misc_feature (34)..(36): n is a, c, g, or t
tgcaggaccagagaattcgaatacaatattgcannntgcatcaggt

SEQ ID NO: 2843 - DNA, 46 bp, Artificial Sequence
  Synthesized adaptor olignonucleotide
  misc_feature (34)..(36): n is a, c, g, or t
tgcaggaccagagaattcgaatacatctctggtnnntgcatcaggt

SEQ ID NO: 2844 - DNA, 46 bp, Artificial Sequence
  Synthesized adaptor olignonucleotide
  misc_feature (34)..(36): n is a, c, g, or t
tgcaggaccagagaattcgaatacaattggaggnnntgcatcaggt

SEQ ID NO: 2845 - DNA, 46 bp, Artificial Sequence
  Synthesized adaptor olignonucleotide
  misc_feature (34)..(36): n is a, c, g, or t
tgcaggaccagagaattcgaatacacatcatttnnntgcatcaggt

SEQ ID NO: 2846 - DNA, 46 bp, Artificial Sequence
  Synthesized adaptor olignonucleotide
  misc_feature (34)..(36): n is a, c, g, or t
tgcaggaccagagaattcgaatacagaggtgatnnntgcatcaggt

SEQ ID NO: 2847 - DNA, 46 bp, Artificial Sequence
  Synthesized adaptor olignonucleotide
  misc_feature (34)..(36): n is a, c, g, or t
tgcaggaccagagaattcgaatacaccccgtcannntgcatcaggt

SEQ ID NO: 2848 - DNA, 46 bp, Artificial Sequence
  Synthesized adaptor olignonucleotide
  misc_feature (34)..(36): n is a, c, g, or t
tgcaggaccagagaattcgaatacagacaggtannntgcatcaggt

SEQ ID NO: 2849 - DNA, 46 bp, Artificial Sequence
  Synthesized adaptor olignonucleotide
  misc_feature (34)..(36): n is a, c, g, or t
tgcaggaccagagaattcgaatacagccttagannntgcatcaggt

SEQ ID NO: 2850 - DNA, 46 bp, Artificial Sequence
  Synthesized adaptor olignonucleotide
  misc_feature (34)..(36): n is a, c, g, or t
tgcaggaccagagaattcgaatacaccttctagnnntgcatcaggt

SEQ ID NO: 2851 - DNA, 46 bp, Artificial Sequence
  Synthesized adaptor olignonucleotide
  misc_feature (34)..(36): n is a, c, g, or t
tgcaggaccagagaattcgaatacaaggcttgtnnntgcatcaggt

SEQ ID NO: 2852 - DNA, 46 bp, Artificial Sequence
  Synthesized adaptor olignonucleotide
  misc_feature (34)..(36): n is a, c, g, or t
tgcaggaccagagaattcgaatacatggagttcnnntgcatcaggt

SEQ ID NO: 2853 - DNA, 46 bp, Artificial Sequence
  Synthesized adaptor olignonucleotide
  misc_feature (34)..(36): n is a, c, g, or t
tgcaggaccagagaattcgaatacaccaccgagnnntgcatcaggt

SEQ ID NO: 2854 - DNA, 46 bp, Artificial Sequence
  Synthesized adaptor olignonucleotide
  misc_feature (34)..(36): n is a, c, g, or t
tgcaggaccagagaattcgaatacaggaatgcannntgcatcaggt

SEQ ID NO: 2855 - DNA, 46 bp, Artificial Sequence
  Synthesized adaptor olignonucleotide
  misc_feature (34)..(36): n is a, c, g, or t
tgcaggaccagagaattcgaatacaacattacannntgcatcaggt

SEQ ID NO: 2856 - DNA, 46 bp, Artificial Sequence
  Synthesized adaptor olignonucleotide
  misc_feature (34)..(36): n is a, c, g, or t
tgcaggaccagagaattcgaatacaagtctctcnnntgcatcaggt

SEQ ID NO: 2857 - DNA, 46 bp, Artificial Sequence
  Synthesized adaptor olignonucleotide
  misc_feature (34)..(36): n is a, c, g, or t
tgcaggaccagagaattcgaatacatagtgccannntgcatcaggt

SEQ ID NO: 2858 - DNA, 46 bp, Artificial Sequence
  Synthesized adaptor olignonucleotide
  misc_feature (34)..(36): n is a, c, g, or t
tgcaggaccagagaattcgaatacagcaatgctnnntgcatcaggt

SEQ ID NO: 2859 - DNA, 46 bp, Artificial Sequence
  Synthesized adaptor olignonucleotide
  misc_feature (34)..(36): n is a, c, g, or t
tgcaggaccagagaattcgaatacagttgaattnnntgcatcaggt

SEQ ID NO: 2860 - DNA, 46 bp, Artificial Sequence
  Synthesized adaptor olignonucleotide
  misc_feature (34)..(36): n is a, c, g, or t
tgcaggaccagagaattcgaatacaccacttcannntgcatcaggt

SEQ ID NO: 2861 - DNA, 46 bp, Artificial Sequence
  Synthesized adaptor olignonucleotide
  misc_feature (34)..(36): n is a, c, g, or t
tgcaggaccagagaattcgaatacatccattcgnnntgcatcaggt

SEQ ID NO: 2862 - DNA, 46 bp, Artificial Sequence
  Synthesized adaptor olignonucleotide
  misc_feature (34)..(36): n is a, c, g, or t
tgcaggaccagagaattcgaatacacactctcannntgcatcaggt

SEQ ID NO: 2863 - DNA, 46 bp, Artificial Sequence
  Synthesized adaptor olignonucleotide
  misc_feature (34)..(36): n is a, c, g, or t
tgcaggaccagagaattcgaatacagacctgatnnntgcatcaggt

SEQ ID NO: 2864 - DNA, 46 bp, Artificial Sequence
  Synthesized adaptor olignonucleotide
  misc_feature (34)..(36): n is a, c, g, or t
tgcaggaccagagaattcgaatacaagagctctnnntgcatcaggt

SEQ ID NO: 2865 - DNA, 46 bp, Artificial Sequence
  Synthesized adaptor olignonucleotide
  misc_feature (34)..(36): n is a, c, g, or t
tgcaggaccagagaattcgaatacactggattgnnntgcatcaggt

SEQ ID NO: 2866 - DNA, 46 bp, Artificial Sequence
  Synthesized adaptor olignonucleotide
  misc_feature (34)..(36): n is a, c, g, or t
tgcaggaccagagaattcgaatacatgctatccnnntgcatcaggt

SEQ ID NO: 2867 - DNA, 46 bp, Artificial Sequence
  Synthesized adaptor olignonucleotide
  misc_feature (34)..(36): n is a, c, g, or t
tgcaggaccagagaattcgaatacagacgttgtnnntgcatcaggt

SEQ ID NO: 2868 - DNA, 46 bp, Artificial Sequence
  Synthesized adaptor olignonucleotide
  misc_feature (34)..(36): n is a, c, g, or t
tgcaggaccagagaattcgaatacaattcatctnnntgcatcaggt

SEQ ID NO: 2869 - DNA, 46 bp, Artificial Sequence
  Synthesized adaptor olignonucleotide
  misc_feature (34)..(36): n is a, c, g, or t
tgcaggaccagagaattcgaatacacgattcagnnntgcatcaggt

SEQ ID NO: 2870 - DNA, 46 bp, Artificial Sequence
  Synthesized adaptor olignonucleotide
  misc_feature (34)..(36): n is a, c, g, or t
tgcaggaccagagaattcgaatacatggtgcatnnntgcatcaggt

SEQ ID NO: 2871 - DNA, 46 bp, Artificial Sequence
  Synthesized adaptor olignonucleotide
  misc_feature (34)..(36): n is a, c, g, or t
tgcaggaccagagaattcgaatacatgtgttttnnntgcatcaggt

SEQ ID NO: 2872 - DNA, 46 bp, Artificial Sequence
  Synthesized adaptor olignonucleotide
  misc_feature (34)..(36): n is a, c, g, or t
tgcaggaccagagaattcgaatacatggcatcannntgcatcaggt

SEQ ID NO: 2873 - DNA, 46 bp, Artificial Sequence
  Synthesized adaptor olignonucleotide
  misc_feature (34)..(36): n is a, c, g, or t
tgcaggaccagagaattcgaatacataagctgcnnntgcatcaggt

SEQ ID NO: 2874 - DNA, 46 bp, Artificial Sequence
  Synthesized adaptor olignonucleotide
  misc_feature (34)..(36): n is a, c, g, or t
tgcaggaccagagaattcgaatacaacggacttnnntgcatcaggt

SEQ ID NO: 2875 - DNA, 46 bp, Artificial Sequence
  Synthesized adaptor olignonucleotide
  misc_feature (34)..(36): n is a, c, g, or t
tgcaggaccagagaattcgaatacatgaattacnnntgcatcaggt

SEQ ID NO: 2876 - DNA, 46 bp, Artificial Sequence
  Synthesized adaptor olignonucleotide
  misc_feature (34)..(36): n is a, c, g, or t
tgcaggaccagagaattcgaatacaaacagagcnnntgcatcaggt

SEQ ID NO: 2877 - DNA, 46 bp, Artificial Sequence
  Synthesized adaptor olignonucleotide
  misc_feature (34)..(36): n is a, c, g, or t
tgcaggaccagagaattcgaatacacatgttccnnntgcatcaggt

SEQ ID NO: 2878 - DNA, 46 bp, Artificial Sequence
  Synthesized adaptor olignonucleotide
  misc_feature (34)..(36): n is a, c, g, or t
tgcaggaccagagaattcgaatacatcgtctacnnntgcatcaggt

SEQ ID NO: 2879 - DNA, 46 bp, Artificial Sequence
  Synthesized adaptor olignonucleotide
  misc_feature (34)..(36): n is a, c, g, or t
tgcaggaccagagaattcgaatacagtagagacnnntgcatcaggt

SEQ ID NO: 2880 - DNA, 46 bp, Artificial Sequence
  Synthesized adaptor olignonucleotide
  misc_feature (34)..(36): n is a, c, g, or t
tgcaggaccagagaattcgaatacatatagtgtnnntgcatcaggt

SEQ ID NO: 2881 - DNA, 46 bp, Artificial Sequence
  Synthesized adaptor olignonucleotide
  misc_feature (34)..(36): n is a, c, g, or t
tgcaggaccagagaattcgaatacaggagagttnnntgcatcaggt

SEQ ID NO: 2882 - DNA, 46 bp, Artificial Sequence
  Synthesized adaptor olignonucleotide
  misc_feature (34)..(36): n is a, c, g, or t
tgcaggaccagagaattcgaatacatacattctnnntgcatcaggt

SEQ ID NO: 2883 - DNA, 46 bp, Artificial Sequence
  Synthesized adaptor olignonucleotide
  misc_feature (34)..(36): n is a, c, g, or t
tgcaggaccagagaattcgaatacacacaatgcnnntgcatcaggt

SEQ ID NO: 2884 - DNA, 46 bp, Artificial Sequence
  Synthesized adaptor olignonucleotide
  misc_feature (34)..(36): n is a, c, g, or t
tgcaggaccagagaattcgaatacagatattacnnntgcatcaggt

SEQ ID NO: 2885 - DNA, 46 bp, Artificial Sequence
  Synthesized adaptor olignonucleotide
  misc_feature (34)..(36): n is a, c, g, or t
tgcaggaccagagaattcgaatacacggcttttnnntgcatcaggt

SEQ ID NO: 2886 - DNA, 46 bp, Artificial Sequence
  Synthesized adaptor olignonucleotide
  misc_feature (34)..(36): n is a, c, g, or t
tgcaggaccagagaattcgaatacagctgctggnnntgcatcaggt

SEQ ID NO: 2887 - DNA, 46 bp, Artificial Sequence
  Synthesized adaptor olignonucleotide
  misc_feature (34)..(36): n is a, c, g, or t
tgcaggaccagagaattcgaatacaaaggcgcgnnntgcatcaggt

SEQ ID NO: 2888 - DNA, 46 bp, Artificial Sequence
  Synthesized adaptor olignonucleotide
  misc_feature (34)..(36): n is a, c, g, or t
tgcaggaccagagaattcgaatacaacggtgaannntgcatcaggt

SEQ ID NO: 2889 - DNA, 46 bp, Artificial Sequence
  Synthesized adaptor olignonucleotide
  misc_feature (34)..(36): n is a, c, g, or t
tgcaggaccagagaattcgaatacaccacggacnnnacgtatgcca

SEQ ID NO: 2890 - DNA, 46 bp, Artificial Sequence
  Synthesized adaptor olignonucleotide
  misc_feature (34)..(36): n is a, c, g, or t
tgcaggaccagagaattcgaatacaaatcctccnnnacgtatgcca

SEQ ID NO: 2891 - DNA, 46 bp, Artificial Sequence
  Synthesized adaptor olignonucleotide
  misc_feature (34)..(36): n is a, c, g, or t
tgcaggaccagagaattcgaatacagtggccgtnnnacgtatgcca

SEQ ID NO: 2892 - DNA, 46 bp, Artificial Sequence
  Synthesized adaptor olignonucleotide
  misc_feature (34)..(36): n is a, c, g, or t
tgcaggaccagagaattcgaatacaagagtagcnnnacgtatgcca

SEQ ID NO: 2893 - DNA, 46 bp, Artificial Sequence
  Synthesized adaptor olignonucleotide
  misc_feature (34)..(36): n is a, c, g, or t
tgcaggaccagagaattcgaatacatcctgcgcnnnacgtatgcca

SEQ ID NO: 2894 - DNA, 46 bp, Artificial Sequence
  Synthesized adaptor olignonucleotide
  misc_feature (34)..(36): n is a, c, g, or t
tgcaggaccagagaattcgaatacattctcgtgnnnacgtatgcca

SEQ ID NO: 2895 - DNA, 46 bp, Artificial Sequence
  Synthesized adaptor olignonucleotide
  misc_feature (34)..(36): n is a, c, g, or t
tgcaggaccagagaattcgaatacatggtatgcnnnacgtatgcca

SEQ ID NO: 2896 - DNA, 46 bp, Artificial Sequence
  Synthesized adaptor olignonucleotide
  misc_feature (34)..(36): n is a, c, g, or t
tgcaggaccagagaattcgaatacaatcactccnnnacgtatgcca

SEQ ID NO: 2897 - DNA, 46 bp, Artificial Sequence
  Synthesized adaptor olignonucleotide
  misc_feature (34)..(36): n is a, c, g, or t
tgcaggaccagagaattcgaatacaaacaaggcnnnacgtatgcca

SEQ ID NO: 2898 - DNA, 46 bp, Artificial Sequence
  Synthesized adaptor olignonucleotide
  misc_feature (34)..(36): n is a, c, g, or t
tgcaggaccagagaattcgaatacaccgtcttannnacgtatgcca

SEQ ID NO: 2899 - DNA, 46 bp, Artificial Sequence
  Synthesized adaptor olignonucleotide
  misc_feature (34)..(36): n is a, c, g, or t
tgcaggaccagagaattcgaatacaaaaaattannnacgtatgcca

SEQ ID NO: 2900 - DNA, 46 bp, Artificial Sequence
  Synthesized adaptor olignonucleotide
  misc_feature (34)..(36): n is a, c, g, or t
tgcaggaccagagaattcgaatacaacacagagnnnacgtatgcca

SEQ ID NO: 2901 - DNA, 46 bp, Artificial Sequence
  Synthesized adaptor olignonucleotide
  misc_feature (34)..(36): n is a, c, g, or t
tgcaggaccagagaattcgaatacaggtgcgctnnnacgtatgcca

SEQ ID NO: 2902 - DNA, 46 bp, Artificial Sequence
  Synthesized adaptor olignonucleotide
  misc_feature (34)..(36): n is a, c, g, or t
tgcaggaccagagaattcgaatacacgtgacgcnnnacgtatgcca

SEQ ID NO: 2903 - DNA, 46 bp, Artificial Sequence
  Synthesized adaptor olignonucleotide
  misc_feature (34)..(36): n is a, c, g, or t
tgcaggaccagagaattcgaatacagaccccctnnnacgtatgcca

SEQ ID NO: 2904 - DNA, 46 bp, Artificial Sequence
  Synthesized adaptor olignonucleotide
  misc_feature (34)..(36): n is a, c, g, or t
tgcaggaccagagaattcgaatacaacatttgannnacgtatgcca

SEQ ID NO: 2905 - DNA, 46 bp, Artificial Sequence
  Synthesized adaptor olignonucleotide
  misc_feature (34)..(36): n is a, c, g, or t
tgcaggaccagagaattcgaatacaggtggcagnnnacgtatgcca

SEQ ID NO: 2906 - DNA, 46 bp, Artificial Sequence
  Synthesized adaptor olignonucleotide
  misc_feature (34)..(36): n is a, c, g, or t
tgcaggaccagagaattcgaatacagaggccagnnnacgtatgcca

SEQ ID NO: 2907 - DNA, 46 bp, Artificial Sequence
  Synthesized adaptor olignonucleotide
  misc_feature (34)..(36): n is a, c, g, or t
tgcaggaccagagaattcgaatacaactcgagtnnnacgtatgcca

SEQ ID NO: 2908 - DNA, 46 bp, Artificial Sequence
  Synthesized adaptor olignonucleotide
  misc_feature (34)..(36): n is a, c, g, or t
tgcaggaccagagaattcgaatacaccaaaaggnnnacgtatgcca

SEQ ID NO: 2909 - DNA, 46 bp, Artificial Sequence
  Synthesized adaptor olignonucleotide
  misc_feature (34)..(36): n is a, c, g, or t
tgcaggaccagagaattcgaatacaaagcaacgnnnacgtatgcca

SEQ ID NO: 2910 - DNA, 46 bp, Artificial Sequence
  Synthesized adaptor olignonucleotide
  misc_feature (34)..(36): n is a, c, g, or t
tgcaggaccagagaattcgaatacacgctttgtnnnacgtatgcca

SEQ ID NO: 2911 - DNA, 46 bp, Artificial Sequence
  Synthesized adaptor olignonucleotide
  misc_feature (34)..(36): n is a, c, g, or t
tgcaggaccagagaattcgaatacatggatgctnnnacgtatgcca

SEQ ID NO: 2912 - DNA, 46 bp, Artificial Sequence
  Synthesized adaptor olignonucleotide
  misc_feature (34)..(36): n is a, c, g, or t
tgcaggaccagagaattcgaatacatcaatggcnnnacgtatgcca

SEQ ID NO: 2913 - DNA, 46 bp, Artificial Sequence
  Synthesized adaptor olignonucleotide
  misc_feature (34)..(36): n is a, c, g, or t
tgcaggaccagagaattcgaatacaaactactannnacgtatgcca

SEQ ID NO: 2914 - DNA, 46 bp, Artificial Sequence
  Synthesized adaptor olignonucleotide
  misc_feature (34)..(36): n is a, c, g, or t
tgcaggaccagagaattcgaatacattgcgatgnnnacgtatgcca

SEQ ID NO: 2915 - DNA, 46 bp, Artificial Sequence
  Synthesized adaptor olignonucleotide
  misc_feature (34)..(36): n is a, c, g, or t
tgcaggaccagagaattcgaatacagagatacgnnnacgtatgcca

SEQ ID NO: 2916 - DNA, 46 bp, Artificial Sequence
  Synthesized adaptor olignonucleotide
  misc_feature (34)..(36): n is a, c, g, or t
tgcaggaccagagaattcgaatacatcctttttnnnacgtatgcca

SEQ ID NO: 2917 - DNA, 46 bp, Artificial Sequence
  Synthesized adaptor olignonucleotide
  misc_feature (34)..(36): n is a, c, g, or t
tgcaggaccagagaattcgaatacagttagcgtnnnacgtatgcca

SEQ ID NO: 2918 - DNA, 46 bp, Artificial Sequence
  Synthesized adaptor olignonucleotide
  misc_feature (34)..(36): n is a, c, g, or t
tgcaggaccagagaattcgaatacagcggcgccnnnacgtatgcca

SEQ ID NO: 2919 - DNA, 46 bp, Artificial Sequence
  Synthesized adaptor olignonucleotide
  misc_feature (34)..(36): n is a, c, g, or t
tgcaggaccagagaattcgaatacaatgctctcnnnacgtatgcca

SEQ ID NO: 2920 - DNA, 46 bp, Artificial Sequence
  Synthesized adaptor olignonucleotide
  misc_feature (34)..(36): n is a, c, g, or t
tgcaggaccagagaattcgaatacattatctacnnnacgtatgcca

SEQ ID NO: 2921 - DNA, 46 bp, Artificial Sequence
  Synthesized adaptor olignonucleotide
  misc_feature (34)..(36): n is a, c, g, or t
tgcaggaccagagaattcgaatacattctattgnnnacgtatgcca

SEQ ID NO: 2922 - DNA, 46 bp, Artificial Sequence
  Synthesized adaptor olignonucleotide
  misc_feature (34)..(36): n is a, c, g, or t
tgcaggaccagagaattcgaatacaccagtacannnacgtatgcca

SEQ ID NO: 2923 - DNA, 46 bp, Artificial Sequence
  Synthesized adaptor olignonucleotide
  misc_feature (34)..(36): n is a, c, g, or t
tgcaggaccagagaattcgaatacaacagaatannnacgtatgcca

SEQ ID NO: 2924 - DNA, 46 bp, Artificial Sequence
  Synthesized adaptor olignonucleotide
  misc_feature (34)..(36): n is a, c, g, or t
tgcaggaccagagaattcgaatacagtatatacnnnacgtatgcca

SEQ ID NO: 2925 - DNA, 46 bp, Artificial Sequence
  Synthesized adaptor olignonucleotide
  misc_feature (34)..(36): n is a, c, g, or t
tgcaggaccagagaattcgaatacatattaacgnnnacgtatgcca

SEQ ID NO: 2926 - DNA, 46 bp, Artificial Sequence
  Synthesized adaptor olignonucleotide
  misc_feature (34)..(36): n is a, c, g, or t
tgcaggaccagagaattcgaatacaggttagagnnnacgtatgcca

SEQ ID NO: 2927 - DNA, 46 bp, Artificial Sequence
  Synthesized adaptor olignonucleotide
  misc_feature (34)..(36): n is a, c, g, or t
tgcaggaccagagaattcgaatacactaggatcnnnacgtatgcca

SEQ ID NO: 2928 - DNA, 46 bp, Artificial Sequence
  Synthesized adaptor olignonucleotide
  misc_feature (34)..(36): n is a, c, g, or t
tgcaggaccagagaattcgaatacagactaggannnacgtatgcca

SEQ ID NO: 2929 - DNA, 46 bp, Artificial Sequence
  Synthesized adaptor olignonucleotide
  misc_feature (34)..(36): n is a, c, g, or t
tgcaggaccagagaattcgaatacaacttatctnnnacgtatgcca

SEQ ID NO: 2930 - DNA, 46 bp, Artificial Sequence
  Synthesized adaptor olignonucleotide
  misc_feature (34)..(36): n is a, c, g, or t
tgcaggaccagagaattcgaatacagacgtccgnnnacgtatgcca

SEQ ID NO: 2931 - DNA, 46 bp, Artificial Sequence
  Synthesized adaptor olignonucleotide
  misc_feature (34)..(36): n is a, c, g, or t
tgcaggaccagagaattcgaatacaatggaaatnnnacgtatgcca

SEQ ID NO: 2932 - DNA, 46 bp, Artificial Sequence
  Synthesized adaptor olignonucleotide
  misc_feature (34)..(36): n is a, c, g, or t
tgcaggaccagagaattcgaatacatgttcaggnnnacgtatgcca

SEQ ID NO: 2933 - DNA, 46 bp, Artificial Sequence
  Synthesized adaptor olignonucleotide
  misc_feature (34)..(36): n is a, c, g, or t
tgcaggaccagagaattcgaatacatgcaatcgnnnacgtatgcca

SEQ ID NO: 2934 - DNA, 46 bp, Artificial Sequence
  Synthesized adaptor olignonucleotide
  misc_feature (34)..(36): n is a, c, g, or t
tgcaggaccagagaattcgaatacattatggatnnnacgtatgcca

SEQ ID NO: 2935 - DNA, 46 bp, Artificial Sequence
  Synthesized adaptor olignonucleotide
  misc_feature (34)..(36): n is a, c, g, or t
tgcaggaccagagaattcgaatacaacatcgtgnnnacgtatgcca

SEQ ID NO: 2936 - DNA, 46 bp, Artificial Sequence
  Synthesized adaptor olignonucleotide
  misc_feature (34)..(36): n is a, c, g, or t
tgcaggaccagagaattcgaatacaaaagtagtnnnacgtatgcca

SEQ ID NO: 2937 - DNA, 46 bp, Artificial Sequence
  Synthesized adaptor olignonucleotide
  misc_feature (34)..(36): n is a, c, g, or t
tgcaggaccagagaattcgaatacataataaccnnnacgtatgcca

SEQ ID NO: 2938 - DNA, 46 bp, Artificial Sequence
  Synthesized adaptor olignonucleotide
  misc_feature (34)..(36): n is a, c, g, or t
tgcaggaccagagaattcgaatacaattctcatnnnacgtatgcca

SEQ ID NO: 2939 - DNA, 46 bp, Artificial Sequence
  Synthesized adaptor olignonucleotide
  misc_feature (34)..(36): n is a, c, g, or t
tgcaggaccagagaattcgaatacaacatccctnnnacgtatgcca

SEQ ID NO: 2940 - DNA, 46 bp, Artificial Sequence
  Synthesized adaptor olignonucleotide
  misc_feature (34)..(36): n is a, c, g, or t
tgcaggaccagagaattcgaatacatgaaagtannnacgtatgcca

SEQ ID NO: 2941 - DNA, 46 bp, Artificial Sequence
  Synthesized adaptor olignonucleotide
  misc_feature (34)..(36): n is a, c, g, or t
tgcaggaccagagaattcgaatacagacattatnnnacgtatgcca

SEQ ID NO: 2942 - DNA, 46 bp, Artificial Sequence
  Synthesized adaptor olignonucleotide
  misc_feature (34)..(36): n is a, c, g, or t
tgcaggaccagagaattcgaatacaggatacgannnacgtatgcca

SEQ ID NO: 2943 - DNA, 46 bp, Artificial Sequence
  Synthesized adaptor olignonucleotide
  misc_feature (34)..(36): n is a, c, g, or t
tgcaggaccagagaattcgaatacagtacatatnnnacgtatgcca

SEQ ID NO: 2944 - DNA, 46 bp, Artificial Sequence
  Synthesized adaptor olignonucleotide
  misc_feature (34)..(36): n is a, c, g, or t
tgcaggaccagagaattcgaatacatcatagcgnnnacgtatgcca

SEQ ID NO: 2945 - DNA, 46 bp, Artificial Sequence
  Synthesized adaptor olignonucleotide
  misc_feature (34)..(36): n is a, c, g, or t
tgcaggaccagagaattcgaatacacttgaacgnnnacgtatgcca

SEQ ID NO: 2946 - DNA, 46 bp, Artificial Sequence
  Synthesized adaptor olignonucleotide
  misc_feature (34)..(36): n is a, c, g, or t
tgcaggaccagagaattcgaatacacttcccaannnacgtatgcca

SEQ ID NO: 2947 - DNA, 46 bp, Artificial Sequence
  Synthesized adaptor olignonucleotide
  misc_feature (34)..(36): n is a, c, g, or t
tgcaggaccagagaattcgaatacaagagccccnnnacgtatgcca

SEQ ID NO: 2948 - DNA, 46 bp, Artificial Sequence
  Synthesized adaptor olignonucleotide
  misc_feature (34)..(36): n is a, c, g, or t
tgcaggaccagagaattcgaatacaataatcacnnnacgtatgcca

SEQ ID NO: 2949 - DNA, 46 bp, Artificial Sequence
  Synthesized adaptor olignonucleotide
  misc_feature (34)..(36): n is a, c, g, or t
tgcaggaccagagaattcgaatacagacgacaannnctagcgttac

SEQ ID NO: 2950 - DNA, 46 bp, Artificial Sequence
  Synthesized adaptor olignonucleotide
  misc_feature (34)..(36): n is a, c, g, or t
tgcaggaccagagaattcgaatacacgaattatnnnctagcgttac

SEQ ID NO: 2951 - DNA, 46 bp, Artificial Sequence
  Synthesized adaptor olignonucleotide
  misc_feature (34)..(36): n is a, c, g, or t
tgcaggaccagagaattcgaatacacgcgctgannnctagcgttac

SEQ ID NO: 2952 - DNA, 46 bp, Artificial Sequence
  Synthesized adaptor olignonucleotide
  misc_feature (34)..(36): n is a, c, g, or t
tgcaggaccagagaattcgaatacatcaattagnnnctagcgttac

SEQ ID NO: 2953 - DNA, 46 bp, Artificial Sequence
  Synthesized adaptor olignonucleotide
  misc_feature (34)..(36): n is a, c, g, or t
tgcaggaccagagaattcgaatacaatgagcagnnnctagcgttac

SEQ ID NO: 2954 - DNA, 46 bp, Artificial Sequence
  Synthesized adaptor olignonucleotide
  misc_feature (34)..(36): n is a, c, g, or t
tgcaggaccagagaattcgaatacatgacttaannnctagcgttac

SEQ ID NO: 2955 - DNA, 46 bp, Artificial Sequence
  Synthesized adaptor olignonucleotide
  misc_feature (34)..(36): n is a, c, g, or t
tgcaggaccagagaattcgaatacatgagaatannnctagcgttac

SEQ ID NO: 2956 - DNA, 46 bp, Artificial Sequence
  Synthesized adaptor olignonucleotide
  misc_feature (34)..(36): n is a, c, g, or t
tgcaggaccagagaattcgaatacactttttctnnnctagcgttac

SEQ ID NO: 2957 - DNA, 46 bp, Artificial Sequence
  Synthesized adaptor olignonucleotide
  misc_feature (34)..(36): n is a, c, g, or t
tgcaggaccagagaattcgaatacagtcgcaatnnnctagcgttac

SEQ ID NO: 2958 - DNA, 46 bp, Artificial Sequence
  Synthesized adaptor olignonucleotide
  misc_feature (34)..(36): n is a, c, g, or t
tgcaggaccagagaattcgaatacaatccatccnnnctagcgttac

SEQ ID NO: 2959 - DNA, 46 bp, Artificial Sequence
  Synthesized adaptor olignonucleotide
  misc_feature (34)..(36): n is a, c, g, or t
tgcaggaccagagaattcgaatacaagatatgannnctagcgttac

SEQ ID NO: 2960 - DNA, 46 bp, Artificial Sequence
  Synthesized adaptor olignonucleotide
  misc_feature (34)..(36): n is a, c, g, or t
tgcaggaccagagaattcgaatacatagctacgnnnctagcgttac

SEQ ID NO: 2961 - DNA, 46 bp, Artificial Sequence
  Synthesized adaptor olignonucleotide
  misc_feature (34)..(36): n is a, c, g, or t
tgcaggaccagagaattcgaatacattacaggcnnnctagcgttac

SEQ ID NO: 2962 - DNA, 46 bp, Artificial Sequence
  Synthesized adaptor olignonucleotide
  misc_feature (34)..(36): n is a, c, g, or t
tgcaggaccagagaattcgaatacagactacacnnnctagcgttac

SEQ ID NO: 2963 - DNA, 46 bp, Artificial Sequence
  Synthesized adaptor olignonucleotide
  misc_feature (34)..(36): n is a, c, g, or t
tgcaggaccagagaattcgaatacaattttaggnnnctagcgttac

SEQ ID NO: 2964 - DNA, 46 bp, Artificial Sequence
  Synthesized adaptor olignonucleotide
  misc_feature (34)..(36): n is a, c, g, or t
tgcaggaccagagaattcgaatacattttcagtnnnctagcgttac

SEQ ID NO: 2965 - DNA, 46 bp, Artificial Sequence
  Synthesized adaptor olignonucleotide
  misc_feature (34)..(36): n is a, c, g, or t
tgcaggaccagagaattcgaatacagcagaacannnctagcgttac

SEQ ID NO: 2966 - DNA, 46 bp, Artificial Sequence
  Synthesized adaptor olignonucleotide
  misc_feature (34)..(36): n is a, c, g, or t
tgcaggaccagagaattcgaatacacgagtagannnctagcgttac

SEQ ID NO: 2967 - DNA, 46 bp, Artificial Sequence
  Synthesized adaptor olignonucleotide
  misc_feature (34)..(36): n is a, c, g, or t
tgcaggaccagagaattcgaatacagtcggaggnnnctagcgttac

SEQ ID NO: 2968 - DNA, 46 bp, Artificial Sequence
  Synthesized adaptor olignonucleotide
  misc_feature (34)..(36): n is a, c, g, or t
tgcaggaccagagaattcgaatacaatgtactannnctagcgttac

SEQ ID NO: 2969 - DNA, 46 bp, Artificial Sequence
  Synthesized adaptor olignonucleotide
  misc_feature (34)..(36): n is a, c, g, or t
tgcaggaccagagaattcgaatacatactccgtnnnctagcgttac

SEQ ID NO: 2970 - DNA, 46 bp, Artificial Sequence
  Synthesized adaptor olignonucleotide
  misc_feature (34)..(36): n is a, c, g, or t
tgcaggaccagagaattcgaatacacacattggnnnctagcgttac

SEQ ID NO: 2971 - DNA, 46 bp, Artificial Sequence
  Synthesized adaptor olignonucleotide
  misc_feature (34)..(36): n is a, c, g, or t
tgcaggaccagagaattcgaatacattagcaatnnnctagcgttac

SEQ ID NO: 2972 - DNA, 46 bp, Artificial Sequence
  Synthesized adaptor olignonucleotide
  misc_feature (34)..(36): n is a, c, g, or t
tgcaggaccagagaattcgaatacatccaacgannnctagcgttac

SEQ ID NO: 2973 - DNA, 46 bp, Artificial Sequence
  Synthesized adaptor olignonucleotide
  misc_feature (34)..(36): n is a, c, g, or t
tgcaggaccagagaattcgaatacattgatcccnnnctagcgttac

SEQ ID NO: 2974 - DNA, 46 bp, Artificial Sequence
  Synthesized adaptor olignonucleotide
  misc_feature (34)..(36): n is a, c, g, or t
tgcaggaccagagaattcgaatacatattaatannnctagcgttac

SEQ ID NO: 2975 - DNA, 46 bp, Artificial Sequence
  Synthesized adaptor olignonucleotide
  misc_feature (34)..(36): n is a, c, g, or t
tgcaggaccagagaattcgaatacataagtttgnnnctagcgttac

SEQ ID NO: 2976 - DNA, 46 bp, Artificial Sequence
  Synthesized adaptor olignonucleotide
  misc_feature (34)..(36): n is a, c, g, or t
tgcaggaccagagaattcgaatacaggccgcgcnnnctagcgttac

SEQ ID NO: 2977 - DNA, 46 bp, Artificial Sequence
  Synthesized adaptor olignonucleotide
  misc_feature (34)..(36): n is a, c, g, or t
tgcaggaccagagaattcgaatacatcacacgannnctagcgttac

SEQ ID NO: 2978 - DNA, 46 bp, Artificial Sequence
  Synthesized adaptor olignonucleotide
  misc_feature (34)..(36): n is a, c, g, or t
tgcaggaccagagaattcgaatacagagtcgttnnnctagcgttac

SEQ ID NO: 2979 - DNA, 46 bp, Artificial Sequence
  Synthesized adaptor olignonucleotide
  misc_feature (34)..(36): n is a, c, g, or t
tgcaggaccagagaattcgaatacaagagccttnnnctagcgttac

SEQ ID NO: 2980 - DNA, 46 bp, Artificial Sequence
  Synthesized adaptor olignonucleotide
  misc_feature (34)..(36): n is a, c, g, or t
tgcaggaccagagaattcgaatacaccttgctannnctagcgttac

SEQ ID NO: 2981 - DNA, 46 bp, Artificial Sequence
  Synthesized adaptor olignonucleotide
  misc_feature (34)..(36): n is a, c, g, or t
tgcaggaccagagaattcgaatacaatcatagtnnnctagcgttac

SEQ ID NO: 2982 - DNA, 46 bp, Artificial Sequence
  Synthesized adaptor olignonucleotide
  misc_feature (34)..(36): n is a, c, g, or t
tgcaggaccagagaattcgaatacatagcaattnnnctagcgttac

SEQ ID NO: 2983 - DNA, 46 bp, Artificial Sequence
  Synthesized adaptor olignonucleotide
  misc_feature (34)..(36): n is a, c, g, or t
tgcaggaccagagaattcgaatacacaattgtannnctagcgttac

SEQ ID NO: 2984 - DNA, 46 bp, Artificial Sequence
  Synthesized adaptor olignonucleotide
  misc_feature (34)..(36): n is a, c, g, or t
tgcaggaccagagaattcgaatacattcggcaannnctagcgttac

SEQ ID NO: 2985 - DNA, 46 bp, Artificial Sequence
  Synthesized adaptor olignonucleotide
  misc_feature (34)..(36): n is a, c, g, or t
tgcaggaccagagaattcgaatacacctagtctnnnctagcgttac

SEQ ID NO: 2986 - DNA, 46 bp, Artificial Sequence
  Synthesized adaptor olignonucleotide
  misc_feature (34)..(36): n is a, c, g, or t
tgcaggaccagagaattcgaatacactaggctannnctagcgttac

SEQ ID NO: 2987 - DNA, 46 bp, Artificial Sequence
  Synthesized adaptor olignonucleotide
  misc_feature (34)..(36): n is a, c, g, or t
tgcaggaccagagaattcgaatacaaatcaatcnnnctagcgttac

SEQ ID NO: 2988 - DNA, 46 bp, Artificial Sequence
  Synthesized adaptor olignonucleotide
  misc_feature (34)..(36): n is a, c, g, or t
tgcaggaccagagaattcgaatacagccctcgtnnnctagcgttac

SEQ ID NO: 2989 - DNA, 46 bp, Artificial Sequence
  Synthesized adaptor olignonucleotide
  misc_feature (34)..(36): n is a, c, g, or t
tgcaggaccagagaattcgaatacaaggttgagnnnctagcgttac

SEQ ID NO: 2990 - DNA, 46 bp, Artificial Sequence
  Synthesized adaptor olignonucleotide
  misc_feature (34)..(36): n is a, c, g, or t
tgcaggaccagagaattcgaatacacagccagcnnnctagcgttac

SEQ ID NO: 2991 - DNA, 46 bp, Artificial Sequence
  Synthesized adaptor olignonucleotide
  misc_feature (34)..(36): n is a, c, g, or t
tgcaggaccagagaattcgaatacaactaatgtnnnctagcgttac

SEQ ID NO: 2992 - DNA, 46 bp, Artificial Sequence
  Synthesized adaptor olignonucleotide
  misc_feature (34)..(36): n is a, c, g, or t
tgcaggaccagagaattcgaatacaggtaagacnnnctagcgttac

SEQ ID NO: 2993 - DNA, 46 bp, Artificial Sequence
  Synthesized adaptor olignonucleotide
  misc_feature (34)..(36): n is a, c, g, or t
tgcaggaccagagaattcgaatacactcgcgagnnnctagcgttac

SEQ ID NO: 2994 - DNA, 46 bp, Artificial Sequence
  Synthesized adaptor olignonucleotide
  misc_feature (34)..(36): n is a, c, g, or t
tgcaggaccagagaattcgaatacactgccgctnnnctagcgttac

SEQ ID NO: 2995 - DNA, 46 bp, Artificial Sequence
  Synthesized adaptor olignonucleotide
  misc_feature (34)..(36): n is a, c, g, or t
tgcaggaccagagaattcgaatacaactgcggcnnnctagcgttac

SEQ ID NO: 2996 - DNA, 46 bp, Artificial Sequence
  Synthesized adaptor olignonucleotide
  misc_feature (34)..(36): n is a, c, g, or t
tgcaggaccagagaattcgaatacacctctacannnctagcgttac

SEQ ID NO: 2997 - DNA, 46 bp, Artificial Sequence
  Synthesized adaptor olignonucleotide
  misc_feature (34)..(36): n is a, c, g, or t
tgcaggaccagagaattcgaatacatggccacgnnnctagcgttac

SEQ ID NO: 2998 - DNA, 46 bp, Artificial Sequence
  Synthesized adaptor olignonucleotide
  misc_feature (34)..(36): n is a, c, g, or t
tgcaggaccagagaattcgaatacaacgcaatcnnnctagcgttac

SEQ ID NO: 2999 - DNA, 46 bp, Artificial Sequence
  Synthesized adaptor olignonucleotide
  misc_feature (34)..(36): n is a, c, g, or t
tgcaggaccagagaattcgaatacaggtttgcannnctagcgttac

SEQ ID NO: 3000 - DNA, 46 bp, Artificial Sequence
  Synthesized adaptor olignonucleotide
  misc_feature (34)..(36): n is a, c, g, or t
tgcaggaccagagaattcgaatacaggttaggannnctagcgttac

SEQ ID NO: 3001 - DNA, 46 bp, Artificial Sequence
  Synthesized adaptor olignonucleotide
  misc_feature (34)..(36): n is a, c, g, or t
tgcaggaccagagaattcgaatacatcctcggcnnnctagcgttac

SEQ ID NO: 3002 - DNA, 46 bp, Artificial Sequence
  Synthesized adaptor olignonucleotide
  misc_feature (34)..(36): n is a, c, g, or t
tgcaggaccagagaattcgaatacaaaacacggnnnctagcgttac

SEQ ID NO: 3003 - DNA, 46 bp, Artificial Sequence
  Synthesized adaptor olignonucleotide
  misc_feature (34)..(36): n is a, c, g, or t
tgcaggaccagagaattcgaatacagaaaatcannnctagcgttac

SEQ ID NO: 3004 - DNA, 46 bp, Artificial Sequence
  Synthesized adaptor olignonucleotide
  misc_feature (34)..(36): n is a, c, g, or t
tgcaggaccagagaattcgaatacacgtatctcnnnctagcgttac

SEQ ID NO: 3005 - DNA, 46 bp, Artificial Sequence
  Synthesized adaptor olignonucleotide
  misc_feature (34)..(36): n is a, c, g, or t
tgcaggaccagagaattcgaatacacggccacannnctagcgttac

SEQ ID NO: 3006 - DNA, 46 bp, Artificial Sequence
  Synthesized adaptor olignonucleotide
  misc_feature (34)..(36): n is a, c, g, or t
tgcaggaccagagaattcgaatacatcattcatnnnctagcgttac

SEQ ID NO: 3007 - DNA, 46 bp, Artificial Sequence
  Synthesized adaptor olignonucleotide
  misc_feature (34)..(36): n is a, c, g, or t
tgcaggaccagagaattcgaatacaatagatgannnctagcgttac

SEQ ID NO: 3008 - DNA, 46 bp, Artificial Sequence
  Synthesized adaptor olignonucleotide
  misc_feature (34)..(36): n is a, c, g, or t
tgcaggaccagagaattcgaatacagcactgcgnnnctagcgttac

SEQ ID NO: 3009 - DNA, 46 bp, Artificial Sequence
  Synthesized adaptor olignonucleotide
  misc_feature (34)..(36): n is a, c, g, or t
tgcaggaccagagaattcgaatacaactccctannngatcgacatg

SEQ ID NO: 3010 - DNA, 46 bp, Artificial Sequence
  Synthesized adaptor olignonucleotide
  misc_feature (34)..(36): n is a, c, g, or t
tgcaggaccagagaattcgaatacaacaaaacannngatcgacatg

SEQ ID NO: 3011 - DNA, 46 bp, Artificial Sequence
  Synthesized adaptor olignonucleotide
  misc_feature (34)..(36): n is a, c, g, or t
tgcaggaccagagaattcgaatacatatgtacannngatcgacatg

SEQ ID NO: 3012 - DNA, 46 bp, Artificial Sequence
  Synthesized adaptor olignonucleotide
  misc_feature (34)..(36): n is a, c, g, or t
tgcaggaccagagaattcgaatacatcggtcttnnngatcgacatg

SEQ ID NO: 3013 - DNA, 46 bp, Artificial Sequence
  Synthesized adaptor olignonucleotide
  misc_feature (34)..(36): n is a, c, g, or t
tgcaggaccagagaattcgaatacatccatattnnngatcgacatg

SEQ ID NO: 3014 - DNA, 46 bp, Artificial Sequence
  Synthesized adaptor olignonucleotide
  misc_feature (34)..(36): n is a, c, g, or t
tgcaggaccagagaattcgaatacaatgactcgnnngatcgacatg

SEQ ID NO: 3015 - DNA, 46 bp, Artificial Sequence
  Synthesized adaptor olignonucleotide
  misc_feature (34)..(36): n is a, c, g, or t
tgcaggaccagagaattcgaatacataatctctnnngatcgacatg

SEQ ID NO: 3016 - DNA, 46 bp, Artificial Sequence
  Synthesized adaptor olignonucleotide
  misc_feature (34)..(36): n is a, c, g, or t
tgcaggaccagagaattcgaatacagaatacttnnngatcgacatg

SEQ ID NO: 3017 - DNA, 46 bp, Artificial Sequence
  Synthesized adaptor olignonucleotide
  misc_feature (34)..(36): n is a, c, g, or t
tgcaggaccagagaattcgaatacaccactagannngatcgacatg

SEQ ID NO: 3018 - DNA, 46 bp, Artificial Sequence
  Synthesized adaptor olignonucleotide
  misc_feature (34)..(36): n is a, c, g, or t
tgcaggaccagagaattcgaatacatttggacgnnngatcgacatg

SEQ ID NO: 3019 - DNA, 46 bp, Artificial Sequence
  Synthesized adaptor olignonucleotide
  misc_feature (34)..(36): n is a, c, g, or t
tgcaggaccagagaattcgaatacagaagtcctnnngatcgacatg

SEQ ID NO: 3020 - DNA, 46 bp, Artificial Sequence
  Synthesized adaptor olignonucleotide
  misc_feature (34)..(36): n is a, c, g, or t
tgcaggaccagagaattcgaatacacctatgctnnngatcgacatg

SEQ ID NO: 3021 - DNA, 46 bp, Artificial Sequence
  Synthesized adaptor olignonucleotide
  misc_feature (34)..(36): n is a, c, g, or t
tgcaggaccagagaattcgaatacatcgatgtgnnngatcgacatg

SEQ ID NO: 3022 - DNA, 46 bp, Artificial Sequence
  Synthesized adaptor olignonucleotide
  misc_feature (34)..(36): n is a, c, g, or t
tgcaggaccagagaattcgaatacatgtacacgnnngatcgacatg

SEQ ID NO: 3023 - DNA, 46 bp, Artificial Sequence
  Synthesized adaptor olignonucleotide
  misc_feature (34)..(36): n is a, c, g, or t
tgcaggaccagagaattcgaatacatctttagtnnngatcgacatg

SEQ ID NO: 3024 - DNA, 46 bp, Artificial Sequence
  Synthesized adaptor olignonucleotide
  misc_feature (34)..(36): n is a, c, g, or t
tgcaggaccagagaattcgaatacacgtaggccnnngatcgacatg

SEQ ID NO: 3025 - DNA, 46 bp, Artificial Sequence
  Synthesized adaptor olignonucleotide
  misc_feature (34)..(36): n is a, c, g, or t
tgcaggaccagagaattcgaatacaacctttatnnngatcgacatg

SEQ ID NO: 3026 - DNA, 46 bp, Artificial Sequence
  Synthesized adaptor olignonucleotide
  misc_feature (34)..(36): n is a, c, g, or t
tgcaggaccagagaattcgaatacacgtctatcnnngatcgacatg

SEQ ID NO: 3027 - DNA, 46 bp, Artificial Sequence
  Synthesized adaptor olignonucleotide
  misc_feature (34)..(36): n is a, c, g, or t
tgcaggaccagagaattcgaatacagtagaaatnnngatcgacatg

SEQ ID NO: 3028 - DNA, 46 bp, Artificial Sequence
  Synthesized adaptor olignonucleotide
  misc_feature (34)..(36): n is a, c, g, or t
tgcaggaccagagaattcgaatacacgtaccaannngatcgacatg

SEQ ID NO: 3029 - DNA, 46 bp, Artificial Sequence
  Synthesized adaptor olignonucleotide
  misc_feature (34)..(36): n is a, c, g, or t
tgcaggaccagagaattcgaatacacaccacccnnngatcgacatg

SEQ ID NO: 3030 - DNA, 46 bp, Artificial Sequence
  Synthesized adaptor olignonucleotide
  misc_feature (34)..(36): n is a, c, g, or t
tgcaggaccagagaattcgaatacatgcggcgtnnngatcgacatg

SEQ ID NO: 3031 - DNA, 46 bp, Artificial Sequence
  Synthesized adaptor olignonucleotide
  misc_feature (34)..(36): n is a, c, g, or t
tgcaggaccagagaattcgaatacagccccccgnnngatcgacatg

SEQ ID NO: 3032 - DNA, 46 bp, Artificial Sequence
  Synthesized adaptor olignonucleotide
  misc_feature (34)..(36): n is a, c, g, or t
tgcaggaccagagaattcgaatacatagtaagannngatcgacatg

SEQ ID NO: 3033 - DNA, 46 bp, Artificial Sequence
  Synthesized adaptor olignonucleotide
  misc_feature (34)..(36): n is a, c, g, or t
tgcaggaccagagaattcgaatacatctgaatannngatcgacatg

SEQ ID NO: 3034 - DNA, 46 bp, Artificial Sequence
  Synthesized adaptor olignonucleotide
  misc_feature (34)..(36): n is a, c, g, or t
tgcaggaccagagaattcgaatacactaatacannngatcgacatg

SEQ ID NO: 3035 - DNA, 46 bp, Artificial Sequence
  Synthesized adaptor olignonucleotide
  misc_feature (34)..(36): n is a, c, g, or t
tgcaggaccagagaattcgaatacaatgtcacgnnngatcgacatg

SEQ ID NO: 3036 - DNA, 46 bp, Artificial Sequence
  Synthesized adaptor olignonucleotide
  misc_feature (34)..(36): n is a, c, g, or t
tgcaggaccagagaattcgaatacaaacagaatnnngatcgacatg

SEQ ID NO: 3037 - DNA, 46 bp, Artificial Sequence
  Synthesized adaptor olignonucleotide
  misc_feature (34)..(36): n is a, c, g, or t
tgcaggaccagagaattcgaatacagcccaggtnnngatcgacatg

SEQ ID NO: 3038 - DNA, 46 bp, Artificial Sequence
  Synthesized adaptor olignonucleotide
  misc_feature (34)..(36): n is a, c, g, or t
tgcaggaccagagaattcgaatacagctcatgannngatcgacatg

SEQ ID NO: 3039 - DNA, 46 bp, Artificial Sequence
  Synthesized adaptor olignonucleotide
  misc_feature (34)..(36): n is a, c, g, or t
tgcaggaccagagaattcgaatacaccggtcgannngatcgacatg

SEQ ID NO: 3040 - DNA, 46 bp, Artificial Sequence
  Synthesized adaptor olignonucleotide
  misc_feature (34)..(36): n is a, c, g, or t
tgcaggaccagagaattcgaatacacaattcccnnngatcgacatg

SEQ ID NO: 3041 - DNA, 46 bp, Artificial Sequence
  Synthesized adaptor olignonucleotide
  misc_feature (34)..(36): n is a, c, g, or t
tgcaggaccagagaattcgaatacaccaggccannngatcgacatg

SEQ ID NO: 3042 - DNA, 46 bp, Artificial Sequence
  Synthesized adaptor olignonucleotide
  misc_feature (34)..(36): n is a, c, g, or t
tgcaggaccagagaattcgaatacacctgcggannngatcgacatg

SEQ ID NO: 3043 - DNA, 46 bp, Artificial Sequence
  Synthesized adaptor olignonucleotide
  misc_feature (34)..(36): n is a, c, g, or t
tgcaggaccagagaattcgaatacagctaaaggnnngatcgacatg

SEQ ID NO: 3044 - DNA, 46 bp, Artificial Sequence
  Synthesized adaptor olignonucleotide
  misc_feature (34)..(36): n is a, c, g, or t
tgcaggaccagagaattcgaatacatttaaggtnnngatcgacatg

SEQ ID NO: 3045 - DNA, 46 bp, Artificial Sequence
  Synthesized adaptor olignonucleotide
  misc_feature (34)..(36): n is a, c, g, or t
tgcaggaccagagaattcgaatacaaaacgtaannngatcgacatg

SEQ ID NO: 3046 - DNA, 46 bp, Artificial Sequence
  Synthesized adaptor olignonucleotide
  misc_feature (34)..(36): n is a, c, g, or t
tgcaggaccagagaattcgaatacaaatttggtnnngatcgacatg

SEQ ID NO: 3047 - DNA, 46 bp, Artificial Sequence
  Synthesized adaptor olignonucleotide
  misc_feature (34)..(36): n is a, c, g, or t
tgcaggaccagagaattcgaatacaacgttagcnnngatcgacatg

SEQ ID NO: 3048 - DNA, 46 bp, Artificial Sequence
  Synthesized adaptor olignonucleotide
  misc_feature (34)..(36): n is a, c, g, or t
tgcaggaccagagaattcgaatacaaagttttgnnngatcgacatg

SEQ ID NO: 3049 - DNA, 46 bp, Artificial Sequence
  Synthesized adaptor olignonucleotide
  misc_feature (34)..(36): n is a, c, g, or t
tgcaggaccagagaattcgaatacaagcgttcannngatcgacatg

SEQ ID NO: 3050 - DNA, 46 bp, Artificial Sequence
  Synthesized adaptor olignonucleotide
  misc_feature (34)..(36): n is a, c, g, or t
tgcaggaccagagaattcgaatacaggacttgtnnngatcgacatg

SEQ ID NO: 3051 - DNA, 46 bp, Artificial Sequence
  Synthesized adaptor olignonucleotide
  misc_feature (34)..(36): n is a, c, g, or t
tgcaggaccagagaattcgaatacacgtcagatnnngatcgacatg

SEQ ID NO: 3052 - DNA, 46 bp, Artificial Sequence
  Synthesized adaptor olignonucleotide
  misc_feature (34)..(36): n is a, c, g, or t
tgcaggaccagagaattcgaatacaccagaagannngatcgacatg

SEQ ID NO: 3053 - DNA, 46 bp, Artificial Sequence
  Synthesized adaptor olignonucleotide
  misc_feature (34)..(36): n is a, c, g, or t
tgcaggaccagagaattcgaatacagcgatctannngatcgacatg

SEQ ID NO: 3054 - DNA, 46 bp, Artificial Sequence
  Synthesized adaptor olignonucleotide
  misc_feature (34)..(36): n is a, c, g, or t
tgcaggaccagagaattcgaatacaatcaccgannngatcgacatg

SEQ ID NO: 3055 - DNA, 46 bp, Artificial Sequence
  Synthesized adaptor olignonucleotide
  misc_feature (34)..(36): n is a, c, g, or t
tgcaggaccagagaattcgaatacaacactaatnnngatcgacatg

SEQ ID NO: 3056 - DNA, 46 bp, Artificial Sequence
  Synthesized adaptor olignonucleotide
  misc_feature (34)..(36): n is a, c, g, or t
tgcaggaccagagaattcgaatacaatatgaagnnngatcgacatg

SEQ ID NO: 3057 - DNA, 46 bp, Artificial Sequence
  Synthesized adaptor olignonucleotide
  misc_feature (34)..(36): n is a, c, g, or t
tgcaggaccagagaattcgaatacaagtaagcgnnngatcgacatg

SEQ ID NO: 3058 - DNA, 46 bp, Artificial Sequence
  Synthesized adaptor olignonucleotide
  misc_feature (34)..(36): n is a, c, g, or t
tgcaggaccagagaattcgaatacagacgctatnnngatcgacatg

SEQ ID NO: 3059 - DNA, 46 bp, Artificial Sequence
  Synthesized adaptor olignonucleotide
  misc_feature (34)..(36): n is a, c, g, or t
tgcaggaccagagaattcgaatacatgacatcgnnngatcgacatg

SEQ ID NO: 3060 - DNA, 46 bp, Artificial Sequence
  Synthesized adaptor olignonucleotide
  misc_feature (34)..(36): n is a, c, g, or t
tgcaggaccagagaattcgaatacagcagaaacnnngatcgacatg

SEQ ID NO: 3061 - DNA, 46 bp, Artificial Sequence
  Synthesized adaptor olignonucleotide
  misc_feature (34)..(36): n is a, c, g, or t
tgcaggaccagagaattcgaatacatttttgcannngatcgacatg

SEQ ID NO: 3062 - DNA, 46 bp, Artificial Sequence
  Synthesized adaptor olignonucleotide
  misc_feature (34)..(36): n is a, c, g, or t
tgcaggaccagagaattcgaatacactacccgcnnngatcgacatg

SEQ ID NO: 3063 - DNA, 46 bp, Artificial Sequence
  Synthesized adaptor olignonucleotide
  misc_feature (34)..(36): n is a, c, g, or t
tgcaggaccagagaattcgaatacaataatgctnnngatcgacatg

SEQ ID NO: 3064 - DNA, 46 bp, Artificial Sequence
  Synthesized adaptor olignonucleotide
  misc_feature (34)..(36): n is a, c, g, or t
tgcaggaccagagaattcgaatacaaagcagtgnnngatcgacatg

SEQ ID NO: 3065 - DNA, 46 bp, Artificial Sequence
  Synthesized adaptor olignonucleotide
  misc_feature (34)..(36): n is a, c, g, or t
tgcaggaccagagaattcgaatacaacacgtcannngatcgacatg

SEQ ID NO: 3066 - DNA, 46 bp, Artificial Sequence
  Synthesized adaptor olignonucleotide
  misc_feature (34)..(36): n is a, c, g, or t
tgcaggaccagagaattcgaatacagtaatactnnngatcgacatg

SEQ ID NO: 3067 - DNA, 46 bp, Artificial Sequence
  Synthesized adaptor olignonucleotide
  misc_feature (34)..(36): n is a, c, g, or t
tgcaggaccagagaattcgaatacaaacaaacannngatcgacatg

SEQ ID NO: 3068 - DNA, 46 bp, Artificial Sequence
  Synthesized adaptor olignonucleotide
  misc_feature (34)..(36): n is a, c, g, or t
tgcaggaccagagaattcgaatacatacatggcnnngatcgacatg

SEQ ID NO: 3069 - DNA, 46 bp, Artificial Sequence
  Synthesized adaptor olignonucleotide
  misc_feature (34)..(36): n is a, c, g, or t
tgcaggaccagagaattcgaatacacgtgtcaannntgcatcaggt

SEQ ID NO: 3070 - DNA, 46 bp, Artificial Sequence
  Synthesized adaptor olignonucleotide
  misc_feature (34)..(36): n is a, c, g, or t
tgcaggaccagagaattcgaatacactttaactnnntgcatcaggt

SEQ ID NO: 3071 - DNA, 46 bp, Artificial Sequence
  Synthesized adaptor olignonucleotide
  misc_feature (34)..(36): n is a, c, g, or t
tgcaggaccagagaattcgaatacagtaaggtgnnntgcatcaggt

SEQ ID NO: 3072 - DNA, 46 bp, Artificial Sequence
  Synthesized adaptor olignonucleotide
  misc_feature (34)..(36): n is a, c, g, or t
tgcaggaccagagaattcgaatacagaatagcgnnntgcatcaggt

SEQ ID NO: 3073 - DNA, 46 bp, Artificial Sequence
  Synthesized adaptor olignonucleotide
  misc_feature (34)..(36): n is a, c, g, or t
tgcaggaccagagaattcgaatacataattaatnnntgcatcaggt

SEQ ID NO: 3074 - DNA, 46 bp, Artificial Sequence
  Synthesized adaptor olignonucleotide
  misc_feature (34)..(36): n is a, c, g, or t
tgcaggaccagagaattcgaatacactcttgtgnnntgcatcaggt

SEQ ID NO: 3075 - DNA, 46 bp, Artificial Sequence
  Synthesized adaptor olignonucleotide
  misc_feature (34)..(36): n is a, c, g, or t
tgcaggaccagagaattcgaatacatgcgcgtgnnntgcatcaggt

SEQ ID NO: 3076 - DNA, 46 bp, Artificial Sequence
  Synthesized adaptor olignonucleotide
  misc_feature (34)..(36): n is a, c, g, or t
tgcaggaccagagaattcgaatacagacgaaacnnntgcatcaggt

SEQ ID NO: 3077 - DNA, 46 bp, Artificial Sequence
  Synthesized adaptor olignonucleotide
  misc_feature (34)..(36): n is a, c, g, or t
tgcaggaccagagaattcgaatacacgtttaggnnntgcatcaggt

SEQ ID NO: 3078 - DNA, 46 bp, Artificial Sequence
  Synthesized adaptor olignonucleotide
  misc_feature (34)..(36): n is a, c, g, or t
tgcaggaccagagaattcgaatacagtagcctannntgcatcaggt

SEQ ID NO: 3079 - DNA, 46 bp, Artificial Sequence
  Synthesized adaptor olignonucleotide
  misc_feature (34)..(36): n is a, c, g, or t
tgcaggaccagagaattcgaatacaattccctgnnntgcatcaggt

SEQ ID NO: 3080 - DNA, 46 bp, Artificial Sequence
  Synthesized adaptor olignonucleotide
  misc_feature (34)..(36): n is a, c, g, or t
tgcaggaccagagaattcgaatacaaacgaaatnnntgcatcaggt

SEQ ID NO: 3081 - DNA, 46 bp, Artificial Sequence
  Synthesized adaptor olignonucleotide
  misc_feature (34)..(36): n is a, c, g, or t
tgcaggaccagagaattcgaatacaaaccccccnnntgcatcaggt

SEQ ID NO: 3082 - DNA, 46 bp, Artificial Sequence
  Synthesized adaptor olignonucleotide
  misc_feature (34)..(36): n is a, c, g, or t
tgcaggaccagagaattcgaatacactatgatannntgcatcaggt

SEQ ID NO: 3083 - DNA, 46 bp, Artificial Sequence
  Synthesized adaptor olignonucleotide
  misc_feature (34)..(36): n is a, c, g, or t
tgcaggaccagagaattcgaatacatacatgatnnntgcatcaggt

SEQ ID NO: 3084 - DNA, 46 bp, Artificial Sequence
  Synthesized adaptor olignonucleotide
  misc_feature (34)..(36): n is a, c, g, or t
tgcaggaccagagaattcgaatacatgtacatannntgcatcaggt

SEQ ID NO: 3085 - DNA, 46 bp, Artificial Sequence
  Synthesized adaptor olignonucleotide
  misc_feature (34)..(36): n is a, c, g, or t
tgcaggaccagagaattcgaatacatacgaaaannntgcatcaggt

SEQ ID NO: 3086 - DNA, 46 bp, Artificial Sequence
  Synthesized adaptor olignonucleotide
  misc_feature (34)..(36): n is a, c, g, or t
tgcaggaccagagaattcgaatacacataacatnnntgcatcaggt

SEQ ID NO: 3087 - DNA, 46 bp, Artificial Sequence
  Synthesized adaptor olignonucleotide
  misc_feature (34)..(36): n is a, c, g, or t
tgcaggaccagagaattcgaatacaggagaatcnnntgcatcaggt

SEQ ID NO: 3088 - DNA, 46 bp, Artificial Sequence
  Synthesized adaptor olignonucleotide
  misc_feature (34)..(36): n is a, c, g, or t
tgcaggaccagagaattcgaatacatcttgtcgnnntgcatcaggt

SEQ ID NO: 3089 - DNA, 46 bp, Artificial Sequence
  Synthesized adaptor olignonucleotide
  misc_feature (34)..(36): n is a, c, g, or t
tgcaggaccagagaattcgaatacataagcgctnnntgcatcaggt

SEQ ID NO: 3090 - DNA, 46 bp, Artificial Sequence
  Synthesized adaptor olignonucleotide
  misc_feature (34)..(36): n is a, c, g, or t
tgcaggaccagagaattcgaatacattctagaannntgcatcaggt

SEQ ID NO: 3091 - DNA, 46 bp, Artificial Sequence
  Synthesized adaptor olignonucleotide
  misc_feature (34)..(36): n is a, c, g, or t
tgcaggaccagagaattcgaatacattgcttgcnnntgcatcaggt

SEQ ID NO: 3092 - DNA, 46 bp, Artificial Sequence
  Synthesized adaptor olignonucleotide
  misc_feature (34)..(36): n is a, c, g, or t
tgcaggaccagagaattcgaatacacagcgtatnnntgcatcaggt

SEQ ID NO: 3093 - DNA, 46 bp, Artificial Sequence
  Synthesized adaptor olignonucleotide
  misc_feature (34)..(36): n is a, c, g, or t
tgcaggaccagagaattcgaatacaaaggagctnnntgcatcaggt

SEQ ID NO: 3094 - DNA, 46 bp, Artificial Sequence
  Synthesized adaptor olignonucleotide
  misc_feature (34)..(36): n is a, c, g, or t
tgcaggaccagagaattcgaatacacatgccttnnntgcatcaggt

SEQ ID NO: 3095 - DNA, 46 bp, Artificial Sequence
  Synthesized adaptor olignonucleotide
  misc_feature (34)..(36): n is a, c, g, or t
tgcaggaccagagaattcgaatacacgcggtgtnnntgcatcaggt

SEQ ID NO: 3096 - DNA, 46 bp, Artificial Sequence
  Synthesized adaptor olignonucleotide
  misc_feature (34)..(36): n is a, c, g, or t
tgcaggaccagagaattcgaatacactgaaaggnnntgcatcaggt

SEQ ID NO: 3097 - DNA, 46 bp, Artificial Sequence
  Synthesized adaptor olignonucleotide
  misc_feature (34)..(36): n is a, c, g, or t
tgcaggaccagagaattcgaatacaagttacgcnnntgcatcaggt

SEQ ID NO: 3098 - DNA, 46 bp, Artificial Sequence
  Synthesized adaptor olignonucleotide
  misc_feature (34)..(36): n is a, c, g, or t
tgcaggaccagagaattcgaatacagctaagctnnntgcatcaggt

SEQ ID NO: 3099 - DNA, 46 bp, Artificial Sequence
  Synthesized adaptor olignonucleotide
  misc_feature (34)..(36): n is a, c, g, or t
tgcaggaccagagaattcgaatacatcgcagtannntgcatcaggt

SEQ ID NO: 3100 - DNA, 46 bp, Artificial Sequence
  Synthesized adaptor olignonucleotide
  misc_feature (34)..(36): n is a, c, g, or t
tgcaggaccagagaattcgaatacacagatcgtnnntgcatcaggt

SEQ ID NO: 3101 - DNA, 46 bp, Artificial Sequence
  Synthesized adaptor olignonucleotide
  misc_feature (34)..(36): n is a, c, g, or t
tgcaggaccagagaattcgaatacacgaaaaatnnntgcatcaggt

SEQ ID NO: 3102 - DNA, 46 bp, Artificial Sequence
  Synthesized adaptor olignonucleotide
  misc_feature (34)..(36): n is a, c, g, or t
tgcaggaccagagaattcgaatacagccagaccnnntgcatcaggt

SEQ ID NO: 3103 - DNA, 46 bp, Artificial Sequence
  Synthesized adaptor olignonucleotide
  misc_feature (34)..(36): n is a, c, g, or t
tgcaggaccagagaattcgaatacagctgcacgnnntgcatcaggt

SEQ ID NO: 3104 - DNA, 46 bp, Artificial Sequence
  Synthesized adaptor olignonucleotide
  misc_feature (34)..(36): n is a, c, g, or t
tgcaggaccagagaattcgaatacactggaactnnntgcatcaggt

SEQ ID NO: 3105 - DNA, 46 bp, Artificial Sequence
  Synthesized adaptor olignonucleotide
  misc_feature (34)..(36): n is a, c, g, or t
tgcaggaccagagaattcgaatacaatagcaaannntgcatcaggt

SEQ ID NO: 3106 - DNA, 46 bp, Artificial Sequence
  Synthesized adaptor olignonucleotide
  misc_feature (34)..(36): n is a, c, g, or t
tgcaggaccagagaattcgaatacagagctatcnnntgcatcaggt

SEQ ID NO: 3107 - DNA, 46 bp, Artificial Sequence
  Synthesized adaptor olignonucleotide
  misc_feature (34)..(36): n is a, c, g, or t
tgcaggaccagagaattcgaatacaaggtatccnnntgcatcaggt

SEQ ID NO: 3108 - DNA, 46 bp, Artificial Sequence
  Synthesized adaptor olignonucleotide
  misc_feature (34)..(36): n is a, c, g, or t
tgcaggaccagagaattcgaatacattggagtcnnntgcatcaggt

SEQ ID NO: 3109 - DNA, 46 bp, Artificial Sequence
  Synthesized adaptor olignonucleotide
  misc_feature (34)..(36): n is a, c, g, or t
tgcaggaccagagaattcgaatacacggcttccnnntgcatcaggt

SEQ ID NO: 3110 - DNA, 46 bp, Artificial Sequence
  Synthesized adaptor olignonucleotide
  misc_feature (34)..(36): n is a, c, g, or t
tgcaggaccagagaattcgaatacatcaggttgnnntgcatcaggt

SEQ ID NO: 3111 - DNA, 46 bp, Artificial Sequence
  Synthesized adaptor olignonucleotide
  misc_feature (34)..(36): n is a, c, g, or t
tgcaggaccagagaattcgaatacacggcgcgcnnntgcatcaggt

SEQ ID NO: 3112 - DNA, 46 bp, Artificial Sequence
  Synthesized adaptor olignonucleotide
  misc_feature (34)..(36): n is a, c, g, or t
tgcaggaccagagaattcgaatacaatgtgtcgnnntgcatcaggt

SEQ ID NO: 3113 - DNA, 46 bp, Artificial Sequence
  Synthesized adaptor olignonucleotide
  misc_feature (34)..(36): n is a, c, g, or t
tgcaggaccagagaattcgaatacactttggagnnntgcatcaggt

SEQ ID NO: 3114 - DNA, 46 bp, Artificial Sequence
  Synthesized adaptor olignonucleotide
  misc_feature (34)..(36): n is a, c, g, or t
tgcaggaccagagaattcgaatacacgcccactnnntgcatcaggt

SEQ ID NO: 3115 - DNA, 46 bp, Artificial Sequence
  Synthesized adaptor olignonucleotide
  misc_feature (34)..(36): n is a, c, g, or t
tgcaggaccagagaattcgaatacaaacactgcnnntgcatcaggt

SEQ ID NO: 3116 - DNA, 46 bp, Artificial Sequence
  Synthesized adaptor olignonucleotide
  misc_feature (34)..(36): n is a, c, g, or t
tgcaggaccagagaattcgaatacagcgccgtannntgcatcaggt

SEQ ID NO: 3117 - DNA, 46 bp, Artificial Sequence
  Synthesized adaptor olignonucleotide
  misc_feature (34)..(36): n is a, c, g, or t
tgcaggaccagagaattcgaatacagtagcatcnnntgcatcaggt

SEQ ID NO: 3118 - DNA, 46 bp, Artificial Sequence
  Synthesized adaptor olignonucleotide
  misc_feature (34)..(36): n is a, c, g, or t
tgcaggaccagagaattcgaatacatgcagcatnnntgcatcaggt

SEQ ID NO: 3119 - DNA, 46 bp, Artificial Sequence
  Synthesized adaptor olignonucleotide
  misc_feature (34)..(36): n is a, c, g, or t
tgcaggaccagagaattcgaatacatgcagactnnntgcatcaggt

SEQ ID NO: 3120 - DNA, 46 bp, Artificial Sequence
  Synthesized adaptor olignonucleotide
  misc_feature (34)..(36): n is a, c, g, or t
tgcaggaccagagaattcgaatacaaagatgcgnnntgcatcaggt

SEQ ID NO: 3121 - DNA, 46 bp, Artificial Sequence
  Synthesized adaptor olignonucleotide
  misc_feature (34)..(36): n is a, c, g, or t
tgcaggaccagagaattcgaatacaaacatatcnnntgcatcaggt

SEQ ID NO: 3122 - DNA, 46 bp, Artificial Sequence
  Synthesized adaptor olignonucleotide
  misc_feature (34)..(36): n is a, c, g, or t
tgcaggaccagagaattcgaatacatggaacgannntgcatcaggt

SEQ ID NO: 3123 - DNA, 46 bp, Artificial Sequence
  Synthesized adaptor olignonucleotide
  misc_feature (34)..(36): n is a, c, g, or t
tgcaggaccagagaattcgaatacatgctcttgnnntgcatcaggt

SEQ ID NO: 3124 - DNA, 46 bp, Artificial Sequence
  Synthesized adaptor olignonucleotide
  misc_feature (34)..(36): n is a, c, g, or t
tgcaggaccagagaattcgaatacaactcctgtnnntgcatcaggt

SEQ ID NO: 3125 - DNA, 46 bp, Artificial Sequence
  Synthesized adaptor olignonucleotide
  misc_feature (34)..(36): n is a, c, g, or t
tgcaggaccagagaattcgaatacaaaacgtggnnntgcatcaggt

SEQ ID NO: 3126 - DNA, 46 bp, Artificial Sequence
  Synthesized adaptor olignonucleotide
  misc_feature (34)..(36): n is a, c, g, or t
tgcaggaccagagaattcgaatacatgtccctannntgcatcaggt

SEQ ID NO: 3127 - DNA, 46 bp, Artificial Sequence
  Synthesized adaptor olignonucleotide
  misc_feature (34)..(36): n is a, c, g, or t
tgcaggaccagagaattcgaatacaaatcgctgnnntgcatcaggt

SEQ ID NO: 3128 - DNA, 46 bp, Artificial Sequence
  Synthesized adaptor olignonucleotide
  misc_feature (34)..(36): n is a, c, g, or t
tgcaggaccagagaattcgaatacagaagcatgnnntgcatcaggt

SEQ ID NO: 3129 - DNA, 46 bp, Artificial Sequence
  Synthesized adaptor olignonucleotide
  misc_feature (34)..(36): n is a, c, g, or t
tgcaggaccagagaattcgaatacacatgcgtannnacgtatgcca

SEQ ID NO: 3130 - DNA, 46 bp, Artificial Sequence
  Synthesized adaptor olignonucleotide
  misc_feature (34)..(36): n is a, c, g, or t
tgcaggaccagagaattcgaatacatcgtgcggnnnacgtatgcca

SEQ ID NO: 3131 - DNA, 46 bp, Artificial Sequence
  Synthesized adaptor olignonucleotide
  misc_feature (34)..(36): n is a, c, g, or t
tgcaggaccagagaattcgaatacagtagtggannnacgtatgcca

SEQ ID NO: 3132 - DNA, 46 bp, Artificial Sequence
  Synthesized adaptor olignonucleotide
  misc_feature (34)..(36): n is a, c, g, or t
tgcaggaccagagaattcgaatacagttgttggnnnacgtatgcca

SEQ ID NO: 3133 - DNA, 46 bp, Artificial Sequence
  Synthesized adaptor olignonucleotide
  misc_feature (34)..(36): n is a, c, g, or t
tgcaggaccagagaattcgaatacaagagcttcnnnacgtatgcca

SEQ ID NO: 3134 - DNA, 46 bp, Artificial Sequence
  Synthesized adaptor olignonucleotide
  misc_feature (34)..(36): n is a, c, g, or t
tgcaggaccagagaattcgaatacagtactgtgnnnacgtatgcca

SEQ ID NO: 3135 - DNA, 46 bp, Artificial Sequence
  Synthesized adaptor olignonucleotide
  misc_feature (34)..(36): n is a, c, g, or t
tgcaggaccagagaattcgaatacaagcaacctnnnacgtatgcca

SEQ ID NO: 3136 - DNA, 46 bp, Artificial Sequence
  Synthesized adaptor olignonucleotide
  misc_feature (34)..(36): n is a, c, g, or t
tgcaggaccagagaattcgaatacagccctgctnnnacgtatgcca

SEQ ID NO: 3137 - DNA, 46 bp, Artificial Sequence
  Synthesized adaptor olignonucleotide
  misc_feature (34)..(36): n is a, c, g, or t
tgcaggaccagagaattcgaatacactctcgcgnnnacgtatgcca

SEQ ID NO: 3138 - DNA, 46 bp, Artificial Sequence
  Synthesized adaptor olignonucleotide
  misc_feature (34)..(36): n is a, c, g, or t
tgcaggaccagagaattcgaatacactacttgcnnnacgtatgcca

SEQ ID NO: 3139 - DNA, 46 bp, Artificial Sequence
  Synthesized adaptor olignonucleotide
  misc_feature (34)..(36): n is a, c, g, or t
tgcaggaccagagaattcgaatacaataatgagnnnacgtatgcca

SEQ ID NO: 3140 - DNA, 46 bp, Artificial Sequence
  Synthesized adaptor olignonucleotide
  misc_feature (34)..(36): n is a, c, g, or t
tgcaggaccagagaattcgaatacaccgtagtannnacgtatgcca

SEQ ID NO: 3141 - DNA, 46 bp, Artificial Sequence
  Synthesized adaptor olignonucleotide
  misc_feature (34)..(36): n is a, c, g, or t
tgcaggaccagagaattcgaatacaagcaacagnnnacgtatgcca

SEQ ID NO: 3142 - DNA, 46 bp, Artificial Sequence
  Synthesized adaptor olignonucleotide
  misc_feature (34)..(36): n is a, c, g, or t
tgcaggaccagagaattcgaatacactgtgtctnnnacgtatgcca

SEQ ID NO: 3143 - DNA, 46 bp, Artificial Sequence
  Synthesized adaptor olignonucleotide
  misc_feature (34)..(36): n is a, c, g, or t
tgcaggaccagagaattcgaatacatccaaacgnnnacgtatgcca

SEQ ID NO: 3144 - DNA, 46 bp, Artificial Sequence
  Synthesized adaptor olignonucleotide
  misc_feature (34)..(36): n is a, c, g, or t
tgcaggaccagagaattcgaatacatgtcaagcnnnacgtatgcca

SEQ ID NO: 3145 - DNA, 46 bp, Artificial Sequence
  Synthesized adaptor olignonucleotide
  misc_feature (34)..(36): n is a, c, g, or t
tgcaggaccagagaattcgaatacaagtgtcacnnnacgtatgcca

SEQ ID NO: 3146 - DNA, 46 bp, Artificial Sequence
  Synthesized adaptor olignonucleotide
  misc_feature (34)..(36): n is a, c, g, or t
tgcaggaccagagaattcgaatacacctcaagannnacgtatgcca

SEQ ID NO: 3147 - DNA, 46 bp, Artificial Sequence
  Synthesized adaptor olignonucleotide
  misc_feature (34)..(36): n is a, c, g, or t
tgcaggaccagagaattcgaatacagtgaaagcnnnacgtatgcca

SEQ ID NO: 3148 - DNA, 46 bp, Artificial Sequence
  Synthesized adaptor olignonucleotide
  misc_feature (34)..(36): n is a, c, g, or t
tgcaggaccagagaattcgaatacattgcgcccnnnacgtatgcca

SEQ ID NO: 3149 - DNA, 46 bp, Artificial Sequence
  Synthesized adaptor olignonucleotide
  misc_feature (34)..(36): n is a, c, g, or t
tgcaggaccagagaattcgaatacagtattgcgnnnacgtatgcca

SEQ ID NO: 3150 - DNA, 46 bp, Artificial Sequence
  Synthesized adaptor olignonucleotide
  misc_feature (34)..(36): n is a, c, g, or t
tgcaggaccagagaattcgaatacaacaaatagnnnacgtatgcca

SEQ ID NO: 3151 - DNA, 46 bp, Artificial Sequence
  Synthesized adaptor olignonucleotide
  misc_feature (34)..(36): n is a, c, g, or t
tgcaggaccagagaattcgaatacactacgcggnnnacgtatgcca

SEQ ID NO: 3152 - DNA, 46 bp, Artificial Sequence
  Synthesized adaptor olignonucleotide
  misc_feature (34)..(36): n is a, c, g, or t
tgcaggaccagagaattcgaatacatgtatacannnacgtatgcca

SEQ ID NO: 3153 - DNA, 46 bp, Artificial Sequence
  Synthesized adaptor olignonucleotide
  misc_feature (34)..(36): n is a, c, g, or t
tgcaggaccagagaattcgaatacaagacctacnnnacgtatgcca

SEQ ID NO: 3154 - DNA, 46 bp, Artificial Sequence
  Synthesized adaptor olignonucleotide
  misc_feature (34)..(36): n is a, c, g, or t
tgcaggaccagagaattcgaatacattcccatgnnnacgtatgcca

SEQ ID NO: 3155 - DNA, 46 bp, Artificial Sequence
  Synthesized adaptor olignonucleotide
  misc_feature (34)..(36): n is a, c, g, or t
tgcaggaccagagaattcgaatacatagcccttnnnacgtatgcca

SEQ ID NO: 3156 - DNA, 46 bp, Artificial Sequence
  Synthesized adaptor olignonucleotide
  misc_feature (34)..(36): n is a, c, g, or t
tgcaggaccagagaattcgaatacaggttcacannnacgtatgcca

SEQ ID NO: 3157 - DNA, 46 bp, Artificial Sequence
  Synthesized adaptor olignonucleotide
  misc_feature (34)..(36): n is a, c, g, or t
tgcaggaccagagaattcgaatacagacgtttgnnnacgtatgcca

SEQ ID NO: 3158 - DNA, 46 bp, Artificial Sequence
  Synthesized adaptor olignonucleotide
  misc_feature (34)..(36): n is a, c, g, or t
tgcaggaccagagaattcgaatacatgttgatannnacgtatgcca

SEQ ID NO: 3159 - DNA, 46 bp, Artificial Sequence
  Synthesized adaptor olignonucleotide
  misc_feature (34)..(36): n is a, c, g, or t
tgcaggaccagagaattcgaatacaagtattacnnnacgtatgcca

SEQ ID NO: 3160 - DNA, 46 bp, Artificial Sequence
  Synthesized adaptor olignonucleotide
  misc_feature (34)..(36): n is a, c, g, or t
tgcaggaccagagaattcgaatacagagaacacnnnacgtatgcca

SEQ ID NO: 3161 - DNA, 46 bp, Artificial Sequence
  Synthesized adaptor olignonucleotide
  misc_feature (34)..(36): n is a, c, g, or t
tgcaggaccagagaattcgaatacacctaaatannnacgtatgcca

SEQ ID NO: 3162 - DNA, 46 bp, Artificial Sequence
  Synthesized adaptor olignonucleotide
  misc_feature (34)..(36): n is a, c, g, or t
tgcaggaccagagaattcgaatacaatttcactnnnacgtatgcca

SEQ ID NO: 3163 - DNA, 46 bp, Artificial Sequence
  Synthesized adaptor olignonucleotide
  misc_feature (34)..(36): n is a, c, g, or t
tgcaggaccagagaattcgaatacagtcaacgtnnnacgtatgcca

SEQ ID NO: 3164 - DNA, 46 bp, Artificial Sequence
  Synthesized adaptor olignonucleotide
  misc_feature (34)..(36): n is a, c, g, or t
tgcaggaccagagaattcgaatacagcgtgctgnnnacgtatgcca

SEQ ID NO: 3165 - DNA, 46 bp, Artificial Sequence
  Synthesized adaptor olignonucleotide
  misc_feature (34)..(36): n is a, c, g, or t
tgcaggaccagagaattcgaatacaaaacccacnnnacgtatgcca

SEQ ID NO: 3166 - DNA, 46 bp, Artificial Sequence
  Synthesized adaptor olignonucleotide
  misc_feature (34)..(36): n is a, c, g, or t
tgcaggaccagagaattcgaatacacccctgtgnnnacgtatgcca

SEQ ID NO: 3167 - DNA, 46 bp, Artificial Sequence
  Synthesized adaptor olignonucleotide
  misc_feature (34)..(36): n is a, c, g, or t
tgcaggaccagagaattcgaatacaagtagcctnnnacgtatgcca

SEQ ID NO: 3168 - DNA, 46 bp, Artificial Sequence
  Synthesized adaptor olignonucleotide
  misc_feature (34)..(36): n is a, c, g, or t
tgcaggaccagagaattcgaatacaatccatggnnnacgtatgcca

SEQ ID NO: 3169 - DNA, 46 bp, Artificial Sequence
  Synthesized adaptor olignonucleotide
  misc_feature (34)..(36): n is a, c, g, or t
tgcaggaccagagaattcgaatacacgcatcttnnnacgtatgcca

SEQ ID NO: 3170 - DNA, 46 bp, Artificial Sequence
  Synthesized adaptor olignonucleotide
  misc_feature (34)..(36): n is a, c, g, or t
tgcaggaccagagaattcgaatacaagaatcccnnnacgtatgcca

SEQ ID NO: 3171 - DNA, 46 bp, Artificial Sequence
  Synthesized adaptor olignonucleotide
  misc_feature (34)..(36): n is a, c, g, or t
tgcaggaccagagaattcgaatacaccttgtgtnnnacgtatgcca

SEQ ID NO: 3172 - DNA, 46 bp, Artificial Sequence
  Synthesized adaptor olignonucleotide
  misc_feature (34)..(36): n is a, c, g, or t
tgcaggaccagagaattcgaatacagaaaccagnnnacgtatgcca

SEQ ID NO: 3173 - DNA, 46 bp, Artificial Sequence
  Synthesized adaptor olignonucleotide
  misc_feature (34)..(36): n is a, c, g, or t
tgcaggaccagagaattcgaatacaggatactcnnnacgtatgcca

SEQ ID NO: 3174 - DNA, 46 bp, Artificial Sequence
  Synthesized adaptor olignonucleotide
  misc_feature (34)..(36): n is a, c, g, or t
tgcaggaccagagaattcgaatacaaggccgagnnnacgtatgcca

SEQ ID NO: 3175 - DNA, 46 bp, Artificial Sequence
  Synthesized adaptor olignonucleotide
  misc_feature (34)..(36): n is a, c, g, or t
tgcaggaccagagaattcgaatacacactgttcnnnacgtatgcca

SEQ ID NO: 3176 - DNA, 46 bp, Artificial Sequence
  Synthesized adaptor olignonucleotide
  misc_feature (34)..(36): n is a, c, g, or t
tgcaggaccagagaattcgaatacagtggaggcnnnacgtatgcca

SEQ ID NO: 3177 - DNA, 46 bp, Artificial Sequence
  Synthesized adaptor olignonucleotide
  misc_feature (34)..(36): n is a, c, g, or t
tgcaggaccagagaattcgaatacaagtatcgcnnnacgtatgcca

SEQ ID NO: 3178 - DNA, 46 bp, Artificial Sequence
  Synthesized adaptor olignonucleotide
  misc_feature (34)..(36): n is a, c, g, or t
tgcaggaccagagaattcgaatacatcgagatcnnnacgtatgcca

SEQ ID NO: 3179 - DNA, 46 bp, Artificial Sequence
  Synthesized adaptor olignonucleotide
  misc_feature (34)..(36): n is a, c, g, or t
tgcaggaccagagaattcgaatacacggtagttnnnacgtatgcca

SEQ ID NO: 3180 - DNA, 46 bp, Artificial Sequence
  Synthesized adaptor olignonucleotide
  misc_feature (34)..(36): n is a, c, g, or t
tgcaggaccagagaattcgaatacaccgtatctnnnacgtatgcca

SEQ ID NO: 3181 - DNA, 46 bp, Artificial Sequence
  Synthesized adaptor olignonucleotide
  misc_feature (34)..(36): n is a, c, g, or t
tgcaggaccagagaattcgaatacaaacgcactnnnacgtatgcca

SEQ ID NO: 3182 - DNA, 46 bp, Artificial Sequence
  Synthesized adaptor olignonucleotide
  misc_feature (34)..(36): n is a, c, g, or t
tgcaggaccagagaattcgaatacaccgattgannnacgtatgcca

SEQ ID NO: 3183 - DNA, 46 bp, Artificial Sequence
  Synthesized adaptor olignonucleotide
  misc_feature (34)..(36): n is a, c, g, or t
tgcaggaccagagaattcgaatacagctctaagnnnacgtatgcca

SEQ ID NO: 3184 - DNA, 46 bp, Artificial Sequence
  Synthesized adaptor olignonucleotide
  misc_feature (34)..(36): n is a, c, g, or t
tgcaggaccagagaattcgaatacaggtgagtannnacgtatgcca

SEQ ID NO: 3185 - DNA, 46 bp, Artificial Sequence
  Synthesized adaptor olignonucleotide
  misc_feature (34)..(36): n is a, c, g, or t
tgcaggaccagagaattcgaatacagcctatgannnacgtatgcca

SEQ ID NO: 3186 - DNA, 46 bp, Artificial Sequence
  Synthesized adaptor olignonucleotide
  misc_feature (34)..(36): n is a, c, g, or t
tgcaggaccagagaattcgaatacaacggagcgnnnacgtatgcca

SEQ ID NO: 3187 - DNA, 46 bp, Artificial Sequence
  Synthesized adaptor olignonucleotide
  misc_feature (34)..(36): n is a, c, g, or t
tgcaggaccagagaattcgaatacactgtgacannnacgtatgcca

SEQ ID NO: 3188 - DNA, 46 bp, Artificial Sequence
  Synthesized adaptor olignonucleotide
  misc_feature (34)..(36): n is a, c, g, or t
tgcaggaccagagaattcgaatacacgtccgtcnnnacgtatgcca

SEQ ID NO: 3189 - DNA, 46 bp, Artificial Sequence
  Synthesized adaptor olignonucleotide
  misc_feature (34)..(36): n is a, c, g, or t
tgcaggaccagagaattcgaatacaatcgtgacnnnctagcgttac

SEQ ID NO: 3190 - DNA, 46 bp, Artificial Sequence
  Synthesized adaptor olignonucleotide
  misc_feature (34)..(36): n is a, c, g, or t
tgcaggaccagagaattcgaatacaccatgtctnnnctagcgttac

SEQ ID NO: 3191 - DNA, 46 bp, Artificial Sequence
  Synthesized adaptor olignonucleotide
  misc_feature (34)..(36): n is a, c, g, or t
tgcaggaccagagaattcgaatacaccttttggnnnctagcgttac

SEQ ID NO: 3192 - DNA, 46 bp, Artificial Sequence
  Synthesized adaptor olignonucleotide
  misc_feature (34)..(36): n is a, c, g, or t
tgcaggaccagagaattcgaatacacgcgtcgannnctagcgttac

SEQ ID NO: 3193 - DNA, 46 bp, Artificial Sequence
  Synthesized adaptor olignonucleotide
  misc_feature (34)..(36): n is a, c, g, or t
tgcaggaccagagaattcgaatacagcccccatnnnctagcgttac

SEQ ID NO: 3194 - DNA, 46 bp, Artificial Sequence
  Synthesized adaptor olignonucleotide
  misc_feature (34)..(36): n is a, c, g, or t
tgcaggaccagagaattcgaatacagtctttcgnnnctagcgttac

SEQ ID NO: 3195 - DNA, 46 bp, Artificial Sequence
  Synthesized adaptor olignonucleotide
  misc_feature (34)..(36): n is a, c, g, or t
tgcaggaccagagaattcgaatacaatccacgannnctagcgttac

SEQ ID NO: 3196 - DNA, 46 bp, Artificial Sequence
  Synthesized adaptor olignonucleotide
  misc_feature (34)..(36): n is a, c, g, or t
tgcaggaccagagaattcgaatacatatgcatannnctagcgttac

SEQ ID NO: 3197 - DNA, 46 bp, Artificial Sequence
  Synthesized adaptor olignonucleotide
  misc_feature (34)..(36): n is a, c, g, or t
tgcaggaccagagaattcgaatacagagaaattnnnctagcgttac

SEQ ID NO: 3198 - DNA, 46 bp, Artificial Sequence
  Synthesized adaptor olignonucleotide
  misc_feature (34)..(36): n is a, c, g, or t
tgcaggaccagagaattcgaatacacctcaatcnnnctagcgttac

SEQ ID NO: 3199 - DNA, 46 bp, Artificial Sequence
  Synthesized adaptor olignonucleotide
  misc_feature (34)..(36): n is a, c, g, or t
tgcaggaccagagaattcgaatacacaaaacaannnctagcgttac

SEQ ID NO: 3200 - DNA, 46 bp, Artificial Sequence
  Synthesized adaptor olignonucleotide
  misc_feature (34)..(36): n is a, c, g, or t
tgcaggaccagagaattcgaatacagtgatgtcnnnctagcgttac

SEQ ID NO: 3201 - DNA, 46 bp, Artificial Sequence
  Synthesized adaptor olignonucleotide
  misc_feature (34)..(36): n is a, c, g, or t
tgcaggaccagagaattcgaatacatgccgtaannnctagcgttac

SEQ ID NO: 3202 - DNA, 46 bp, Artificial Sequence
  Synthesized adaptor olignonucleotide
  misc_feature (34)..(36): n is a, c, g, or t
tgcaggaccagagaattcgaatacaagctctagnnnctagcgttac

SEQ ID NO: 3203 - DNA, 46 bp, Artificial Sequence
  Synthesized adaptor olignonucleotide
  misc_feature (34)..(36): n is a, c, g, or t
tgcaggaccagagaattcgaatacaggcgtgctnnnctagcgttac

SEQ ID NO: 3204 - DNA, 46 bp, Artificial Sequence
  Synthesized adaptor olignonucleotide
  misc_feature (34)..(36): n is a, c, g, or t
tgcaggaccagagaattcgaatacagacgtcatnnnctagcgttac

SEQ ID NO: 3205 - DNA, 46 bp, Artificial Sequence
  Synthesized adaptor olignonucleotide
  misc_feature (34)..(36): n is a, c, g, or t
tgcaggaccagagaattcgaatacatgtattagnnnctagcgttac

SEQ ID NO: 3206 - DNA, 46 bp, Artificial Sequence
  Synthesized adaptor olignonucleotide
  misc_feature (34)..(36): n is a, c, g, or t
tgcaggaccagagaattcgaatacaatgattacnnnctagcgttac

SEQ ID NO: 3207 - DNA, 46 bp, Artificial Sequence
  Synthesized adaptor olignonucleotide
  misc_feature (34)..(36): n is a, c, g, or t
tgcaggaccagagaattcgaatacaactccgaannnctagcgttac

SEQ ID NO: 3208 - DNA, 46 bp, Artificial Sequence
  Synthesized adaptor olignonucleotide
  misc_feature (34)..(36): n is a, c, g, or t
tgcaggaccagagaattcgaatacattcttcccnnnctagcgttac

SEQ ID NO: 3209 - DNA, 46 bp, Artificial Sequence
  Synthesized adaptor olignonucleotide
  misc_feature (34)..(36): n is a, c, g, or t
tgcaggaccagagaattcgaatacatctcctagnnnctagcgttac

SEQ ID NO: 3210 - DNA, 46 bp, Artificial Sequence
  Synthesized adaptor olignonucleotide
  misc_feature (34)..(36): n is a, c, g, or t
tgcaggaccagagaattcgaatacagacttatannnctagcgttac

SEQ ID NO: 3211 - DNA, 46 bp, Artificial Sequence
  Synthesized adaptor olignonucleotide
  misc_feature (34)..(36): n is a, c, g, or t
tgcaggaccagagaattcgaatacacgagtgaannnctagcgttac

SEQ ID NO: 3212 - DNA, 46 bp, Artificial Sequence
  Synthesized adaptor olignonucleotide
  misc_feature (34)..(36): n is a, c, g, or t
tgcaggaccagagaattcgaatacatataaattnnnctagcgttac

SEQ ID NO: 3213 - DNA, 46 bp, Artificial Sequence
  Synthesized adaptor olignonucleotide
  misc_feature (34)..(36): n is a, c, g, or t
tgcaggaccagagaattcgaatacagcggtgagnnnctagcgttac

SEQ ID NO: 3214 - DNA, 46 bp, Artificial Sequence
  Synthesized adaptor olignonucleotide
  misc_feature (34)..(36): n is a, c, g, or t
tgcaggaccagagaattcgaatacaagtcccttnnnctagcgttac

SEQ ID NO: 3215 - DNA, 46 bp, Artificial Sequence
  Synthesized adaptor olignonucleotide
  misc_feature (34)..(36): n is a, c, g, or t
tgcaggaccagagaattcgaatacaagacttatnnnctagcgttac

SEQ ID NO: 3216 - DNA, 46 bp, Artificial Sequence
  Synthesized adaptor olignonucleotide
  misc_feature (34)..(36): n is a, c, g, or t
tgcaggaccagagaattcgaatacatggcactannnctagcgttac

SEQ ID NO: 3217 - DNA, 46 bp, Artificial Sequence
  Synthesized adaptor olignonucleotide
  misc_feature (34)..(36): n is a, c, g, or t
tgcaggaccagagaattcgaatacaattcctatnnnctagcgttac

SEQ ID NO: 3218 - DNA, 46 bp, Artificial Sequence
  Synthesized adaptor olignonucleotide
  misc_feature (34)..(36): n is a, c, g, or t
tgcaggaccagagaattcgaatacactgatatannnctagcgttac

SEQ ID NO: 3219 - DNA, 46 bp, Artificial Sequence
  Synthesized adaptor olignonucleotide
  misc_feature (34)..(36): n is a, c, g, or t
tgcaggaccagagaattcgaatacacaagcactnnnctagcgttac

SEQ ID NO: 3220 - DNA, 46 bp, Artificial Sequence
  Synthesized adaptor olignonucleotide
  misc_feature (34)..(36): n is a, c, g, or t
tgcaggaccagagaattcgaatacagcgcatgcnnnctagcgttac

SEQ ID NO: 3221 - DNA, 46 bp, Artificial Sequence
  Synthesized adaptor olignonucleotide
  misc_feature (34)..(36): n is a, c, g, or t
tgcaggaccagagaattcgaatacattctcaatnnnctagcgttac

SEQ ID NO: 3222 - DNA, 46 bp, Artificial Sequence
  Synthesized adaptor olignonucleotide
  misc_feature (34)..(36): n is a, c, g, or t
tgcaggaccagagaattcgaatacatcgccaccnnnctagcgttac

SEQ ID NO: 3223 - DNA, 46 bp, Artificial Sequence
  Synthesized adaptor olignonucleotide
  misc_feature (34)..(36): n is a, c, g, or t
tgcaggaccagagaattcgaatacaggacggacnnnctagcgttac

SEQ ID NO: 3224 - DNA, 46 bp, Artificial Sequence
  Synthesized adaptor olignonucleotide
  misc_feature (34)..(36): n is a, c, g, or t
tgcaggaccagagaattcgaatacacgaacagannnctagcgttac

SEQ ID NO: 3225 - DNA, 46 bp, Artificial Sequence
  Synthesized adaptor olignonucleotide
  misc_feature (34)..(36): n is a, c, g, or t
tgcaggaccagagaattcgaatacatatctcgcnnnctagcgttac

SEQ ID NO: 3226 - DNA, 46 bp, Artificial Sequence
  Synthesized adaptor olignonucleotide
  misc_feature (34)..(36): n is a, c, g, or t
tgcaggaccagagaattcgaatacatgcatcagnnnctagcgttac

SEQ ID NO: 3227 - DNA, 46 bp, Artificial Sequence
  Synthesized adaptor olignonucleotide
  misc_feature (34)..(36): n is a, c, g, or t
tgcaggaccagagaattcgaatacacctaaagcnnnctagcgttac

SEQ ID NO: 3228 - DNA, 46 bp, Artificial Sequence
  Synthesized adaptor olignonucleotide
  misc_feature (34)..(36): n is a, c, g, or t
tgcaggaccagagaattcgaatacatttgacaannnctagcgttac

SEQ ID NO: 3229 - DNA, 46 bp, Artificial Sequence
  Synthesized adaptor olignonucleotide
  misc_feature (34)..(36): n is a, c, g, or t
tgcaggaccagagaattcgaatacacccgccatnnnctagcgttac

SEQ ID NO: 3230 - DNA, 46 bp, Artificial Sequence
  Synthesized adaptor olignonucleotide
  misc_feature (34)..(36): n is a, c, g, or t
tgcaggaccagagaattcgaatacattgcataannnctagcgttac

SEQ ID NO: 3231 - DNA, 46 bp, Artificial Sequence
  Synthesized adaptor olignonucleotide
  misc_feature (34)..(36): n is a, c, g, or t
tgcaggaccagagaattcgaatacaacagagcannnctagcgttac

SEQ ID NO: 3232 - DNA, 46 bp, Artificial Sequence
  Synthesized adaptor olignonucleotide
  misc_feature (34)..(36): n is a, c, g, or t
tgcaggaccagagaattcgaatacaggtacgttnnnctagcgttac

SEQ ID NO: 3233 - DNA, 46 bp, Artificial Sequence
  Synthesized adaptor olignonucleotide
  misc_feature (34)..(36): n is a, c, g, or t
tgcaggaccagagaattcgaatacagatgcactnnnctagcgttac

SEQ ID NO: 3234 - DNA, 46 bp, Artificial Sequence
  Synthesized adaptor olignonucleotide
  misc_feature (34)..(36): n is a, c, g, or t
tgcaggaccagagaattcgaatacaatctaaacnnnctagcgttac

SEQ ID NO: 3235 - DNA, 46 bp, Artificial Sequence
  Synthesized adaptor olignonucleotide
  misc_feature (34)..(36): n is a, c, g, or t
tgcaggaccagagaattcgaatacaacgagaacnnnctagcgttac

SEQ ID NO: 3236 - DNA, 46 bp, Artificial Sequence
  Synthesized adaptor olignonucleotide
  misc_feature (34)..(36): n is a, c, g, or t
tgcaggaccagagaattcgaatacaccgcaagcnnnctagcgttac

SEQ ID NO: 3237 - DNA, 46 bp, Artificial Sequence
  Synthesized adaptor olignonucleotide
  misc_feature (34)..(36): n is a, c, g, or t
tgcaggaccagagaattcgaatacaacgacaagnnnctagcgttac

SEQ ID NO: 3238 - DNA, 46 bp, Artificial Sequence
  Synthesized adaptor olignonucleotide
  misc_feature (34)..(36): n is a, c, g, or t
tgcaggaccagagaattcgaatacacgccgatgnnnctagcgttac

SEQ ID NO: 3239 - DNA, 46 bp, Artificial Sequence
  Synthesized adaptor olignonucleotide
  misc_feature (34)..(36): n is a, c, g, or t
tgcaggaccagagaattcgaatacaaatccagcnnnctagcgttac

SEQ ID NO: 3240 - DNA, 46 bp, Artificial Sequence
  Synthesized adaptor olignonucleotide
  misc_feature (34)..(36): n is a, c, g, or t
tgcaggaccagagaattcgaatacaattaatgcnnnctagcgttac

SEQ ID NO: 3241 - DNA, 46 bp, Artificial Sequence
  Synthesized adaptor olignonucleotide
  misc_feature (34)..(36): n is a, c, g, or t
tgcaggaccagagaattcgaatacagcgcttccnnnctagcgttac

SEQ ID NO: 3242 - DNA, 46 bp, Artificial Sequence
  Synthesized adaptor olignonucleotide
  misc_feature (34)..(36): n is a, c, g, or t
tgcaggaccagagaattcgaatacatacaattgnnnctagcgttac

SEQ ID NO: 3243 - DNA, 46 bp, Artificial Sequence
  Synthesized adaptor olignonucleotide
  misc_feature (34)..(36): n is a, c, g, or t
tgcaggaccagagaattcgaatacagtggaacannnctagcgttac

SEQ ID NO: 3244 - DNA, 46 bp, Artificial Sequence
  Synthesized adaptor olignonucleotide
  misc_feature (34)..(36): n is a, c, g, or t
tgcaggaccagagaattcgaatacactctgtgtnnnctagcgttac

SEQ ID NO: 3245 - DNA, 46 bp, Artificial Sequence
  Synthesized adaptor olignonucleotide
  misc_feature (34)..(36): n is a, c, g, or t
tgcaggaccagagaattcgaatacatgcagtacnnnctagcgttac

SEQ ID NO: 3246 - DNA, 46 bp, Artificial Sequence
  Synthesized adaptor olignonucleotide
  misc_feature (34)..(36): n is a, c, g, or t
tgcaggaccagagaattcgaatacagacaactcnnnctagcgttac

SEQ ID NO: 3247 - DNA, 46 bp, Artificial Sequence
  Synthesized adaptor olignonucleotide
  misc_feature (34)..(36): n is a, c, g, or t
tgcaggaccagagaattcgaatacacgagaggcnnnctagcgttac

SEQ ID NO: 3248 - DNA, 46 bp, Artificial Sequence
  Synthesized adaptor olignonucleotide
  misc_feature (34)..(36): n is a, c, g, or t
tgcaggaccagagaattcgaatacactaaatgtnnnctagcgttac

SEQ ID NO: 3249 - DNA, 46 bp, Artificial Sequence
  Synthesized adaptor olignonucleotide
  misc_feature (34)..(36): n is a, c, g, or t
tgcaggaccagagaattcgaatacaggctcacgnnngatcgacatg

SEQ ID NO: 3250 - DNA, 46 bp, Artificial Sequence
  Synthesized adaptor olignonucleotide
  misc_feature (34)..(36): n is a, c, g, or t
tgcaggaccagagaattcgaatacaacgtttccnnngatcgacatg

SEQ ID NO: 3251 - DNA, 46 bp, Artificial Sequence
  Synthesized adaptor olignonucleotide
  misc_feature (34)..(36): n is a, c, g, or t
tgcaggaccagagaattcgaatacatgccagtannngatcgacatg

SEQ ID NO: 3252 - DNA, 46 bp, Artificial Sequence
  Synthesized adaptor olignonucleotide
  misc_feature (34)..(36): n is a, c, g, or t
tgcaggaccagagaattcgaatacagtaagtggnnngatcgacatg

SEQ ID NO: 3253 - DNA, 46 bp, Artificial Sequence
  Synthesized adaptor olignonucleotide
  misc_feature (34)..(36): n is a, c, g, or t
tgcaggaccagagaattcgaatacacacctactnnngatcgacatg

SEQ ID NO: 3254 - DNA, 46 bp, Artificial Sequence
  Synthesized adaptor olignonucleotide
  misc_feature (34)..(36): n is a, c, g, or t
tgcaggaccagagaattcgaatacagatttgatnnngatcgacatg

SEQ ID NO: 3255 - DNA, 46 bp, Artificial Sequence
  Synthesized adaptor olignonucleotide
  misc_feature (34)..(36): n is a, c, g, or t
tgcaggaccagagaattcgaatacaaactacatnnngatcgacatg

SEQ ID NO: 3256 - DNA, 46 bp, Artificial Sequence
  Synthesized adaptor olignonucleotide
  misc_feature (34)..(36): n is a, c, g, or t
tgcaggaccagagaattcgaatacagccttgaannngatcgacatg

SEQ ID NO: 3257 - DNA, 46 bp, Artificial Sequence
  Synthesized adaptor olignonucleotide
  misc_feature (34)..(36): n is a, c, g, or t
tgcaggaccagagaattcgaatacataatattannngatcgacatg

SEQ ID NO: 3258 - DNA, 46 bp, Artificial Sequence
  Synthesized adaptor olignonucleotide
  misc_feature (34)..(36): n is a, c, g, or t
tgcaggaccagagaattcgaatacaggtttaatnnngatcgacatg

SEQ ID NO: 3259 - DNA, 46 bp, Artificial Sequence
  Synthesized adaptor olignonucleotide
  misc_feature (34)..(36): n is a, c, g, or t
tgcaggaccagagaattcgaatacacccaccgtnnngatcgacatg

SEQ ID NO: 3260 - DNA, 46 bp, Artificial Sequence
  Synthesized adaptor olignonucleotide
  misc_feature (34)..(36): n is a, c, g, or t
tgcaggaccagagaattcgaatacactacttcgnnngatcgacatg

SEQ ID NO: 3261 - DNA, 46 bp, Artificial Sequence
  Synthesized adaptor olignonucleotide
  misc_feature (34)..(36): n is a, c, g, or t
tgcaggaccagagaattcgaatacaatgcgtcannngatcgacatg

SEQ ID NO: 3262 - DNA, 46 bp, Artificial Sequence
  Synthesized adaptor olignonucleotide
  misc_feature (34)..(36): n is a, c, g, or t
tgcaggaccagagaattcgaatacaaacatgttnnngatcgacatg

SEQ ID NO: 3263 - DNA, 46 bp, Artificial Sequence
  Synthesized adaptor olignonucleotide
  misc_feature (34)..(36): n is a, c, g, or t
tgcaggaccagagaattcgaatacacctgtttgnnngatcgacatg

SEQ ID NO: 3264 - DNA, 46 bp, Artificial Sequence
  Synthesized adaptor olignonucleotide
  misc_feature (34)..(36): n is a, c, g, or t
tgcaggaccagagaattcgaatacacacaagctnnngatcgacatg

SEQ ID NO: 3265 - DNA, 46 bp, Artificial Sequence
  Synthesized adaptor olignonucleotide
  misc_feature (34)..(36): n is a, c, g, or t
tgcaggaccagagaattcgaatacagataagatnnngatcgacatg

SEQ ID NO: 3266 - DNA, 46 bp, Artificial Sequence
  Synthesized adaptor olignonucleotide
  misc_feature (34)..(36): n is a, c, g, or t
tgcaggaccagagaattcgaatacaagacctcannngatcgacatg

SEQ ID NO: 3267 - DNA, 46 bp, Artificial Sequence
  Synthesized adaptor olignonucleotide
  misc_feature (34)..(36): n is a, c, g, or t
tgcaggaccagagaattcgaatacactccaagannngatcgacatg

SEQ ID NO: 3268 - DNA, 46 bp, Artificial Sequence
  Synthesized adaptor olignonucleotide
  misc_feature (34)..(36): n is a, c, g, or t
tgcaggaccagagaattcgaatacaggtattcgnnngatcgacatg

SEQ ID NO: 3269 - DNA, 46 bp, Artificial Sequence
  Synthesized adaptor olignonucleotide
  misc_feature (34)..(36): n is a, c, g, or t
tgcaggaccagagaattcgaatacaactcggatnnngatcgacatg

SEQ ID NO: 3270 - DNA, 46 bp, Artificial Sequence
  Synthesized adaptor olignonucleotide
  misc_feature (34)..(36): n is a, c, g, or t
tgcaggaccagagaattcgaatacatatatcgannngatcgacatg

SEQ ID NO: 3271 - DNA, 46 bp, Artificial Sequence
  Synthesized adaptor olignonucleotide
  misc_feature (34)..(36): n is a, c, g, or t
tgcaggaccagagaattcgaatacaatccactcnnngatcgacatg

SEQ ID NO: 3272 - DNA, 46 bp, Artificial Sequence
  Synthesized adaptor olignonucleotide
  misc_feature (34)..(36): n is a, c, g, or t
tgcaggaccagagaattcgaatacagaactggannngatcgacatg

SEQ ID NO: 3273 - DNA, 46 bp, Artificial Sequence
  Synthesized adaptor olignonucleotide
  misc_feature (34)..(36): n is a, c, g, or t
tgcaggaccagagaattcgaatacagatcagagnnngatcgacatg

SEQ ID NO: 3274 - DNA, 46 bp, Artificial Sequence
  Synthesized adaptor olignonucleotide
  misc_feature (34)..(36): n is a, c, g, or t
tgcaggaccagagaattcgaatacattgaactannngatcgacatg

SEQ ID NO: 3275 - DNA, 46 bp, Artificial Sequence
  Synthesized adaptor olignonucleotide
  misc_feature (34)..(36): n is a, c, g, or t
tgcaggaccagagaattcgaatacagccagccannngatcgacatg

SEQ ID NO: 3276 - DNA, 46 bp, Artificial Sequence
  Synthesized adaptor olignonucleotide
  misc_feature (34)..(36): n is a, c, g, or t
tgcaggaccagagaattcgaatacatttactgtnnngatcgacatg

SEQ ID NO: 3277 - DNA, 46 bp, Artificial Sequence
  Synthesized adaptor olignonucleotide
  misc_feature (34)..(36): n is a, c, g, or t
tgcaggaccagagaattcgaatacatgtcaggtnnngatcgacatg

SEQ ID NO: 3278 - DNA, 46 bp, Artificial Sequence
  Synthesized adaptor olignonucleotide
  misc_feature (34)..(36): n is a, c, g, or t
tgcaggaccagagaattcgaatacacagcgttannngatcgacatg

SEQ ID NO: 3279 - DNA, 46 bp, Artificial Sequence
  Synthesized adaptor olignonucleotide
  misc_feature (34)..(36): n is a, c, g, or t
tgcaggaccagagaattcgaatacatgtgatcgnnngatcgacatg

SEQ ID NO: 3280 - DNA, 46 bp, Artificial Sequence
  Synthesized adaptor olignonucleotide
  misc_feature (34)..(36): n is a, c, g, or t
tgcaggaccagagaattcgaatacagctcgtaannngatcgacatg

SEQ ID NO: 3281 - DNA, 46 bp, Artificial Sequence
  Synthesized adaptor olignonucleotide
  misc_feature (34)..(36): n is a, c, g, or t
tgcaggaccagagaattcgaatacaattctactnnngatcgacatg

SEQ ID NO: 3282 - DNA, 46 bp, Artificial Sequence
  Synthesized adaptor olignonucleotide
  misc_feature (34)..(36): n is a, c, g, or t
tgcaggaccagagaattcgaatacagatcagtcnnngatcgacatg

SEQ ID NO: 3283 - DNA, 46 bp, Artificial Sequence
  Synthesized adaptor olignonucleotide
  misc_feature (34)..(36): n is a, c, g, or t
tgcaggaccagagaattcgaatacaggattattnnngatcgacatg

SEQ ID NO: 3284 - DNA, 46 bp, Artificial Sequence
  Synthesized adaptor olignonucleotide
  misc_feature (34)..(36): n is a, c, g, or t
tgcaggaccagagaattcgaatacaccattcgtnnngatcgacatg

SEQ ID NO: 3285 - DNA, 46 bp, Artificial Sequence
  Synthesized adaptor olignonucleotide
  misc_feature (34)..(36): n is a, c, g, or t
tgcaggaccagagaattcgaatacagtacatgcnnngatcgacatg

SEQ ID NO: 3286 - DNA, 46 bp, Artificial Sequence
  Synthesized adaptor olignonucleotide
  misc_feature (34)..(36): n is a, c, g, or t
tgcaggaccagagaattcgaatacacgtcgcagnnngatcgacatg

SEQ ID NO: 3287 - DNA, 46 bp, Artificial Sequence
  Synthesized adaptor olignonucleotide
  misc_feature (34)..(36): n is a, c, g, or t
tgcaggaccagagaattcgaatacatatttgtcnnngatcgacatg

SEQ ID NO: 3288 - DNA, 46 bp, Artificial Sequence
  Synthesized adaptor olignonucleotide
  misc_feature (34)..(36): n is a, c, g, or t
tgcaggaccagagaattcgaatacaacagtccannngatcgacatg

SEQ ID NO: 3289 - DNA, 46 bp, Artificial Sequence
  Synthesized adaptor olignonucleotide
  misc_feature (34)..(36): n is a, c, g, or t
tgcaggaccagagaattcgaatacagcgattgtnnngatcgacatg

SEQ ID NO: 3290 - DNA, 46 bp, Artificial Sequence
  Synthesized adaptor olignonucleotide
  misc_feature (34)..(36): n is a, c, g, or t
tgcaggaccagagaattcgaatacacctggaatnnngatcgacatg

SEQ ID NO: 3291 - DNA, 46 bp, Artificial Sequence
  Synthesized adaptor olignonucleotide
  misc_feature (34)..(36): n is a, c, g, or t
tgcaggaccagagaattcgaatacaacgagcaannngatcgacatg

SEQ ID NO: 3292 - DNA, 46 bp, Artificial Sequence
  Synthesized adaptor olignonucleotide
  misc_feature (34)..(36): n is a, c, g, or t
tgcaggaccagagaattcgaatacaacaccaacnnngatcgacatg

SEQ ID NO: 3293 - DNA, 46 bp, Artificial Sequence
  Synthesized adaptor olignonucleotide
  misc_feature (34)..(36): n is a, c, g, or t
tgcaggaccagagaattcgaatacatttagtctnnngatcgacatg

SEQ ID NO: 3294 - DNA, 46 bp, Artificial Sequence
  Synthesized adaptor olignonucleotide
  misc_feature (34)..(36): n is a, c, g, or t
tgcaggaccagagaattcgaatacatgtagctgnnngatcgacatg

SEQ ID NO: 3295 - DNA, 46 bp, Artificial Sequence
  Synthesized adaptor olignonucleotide
  misc_feature (34)..(36): n is a, c, g, or t
tgcaggaccagagaattcgaatacaggcttacannngatcgacatg

SEQ ID NO: 3296 - DNA, 46 bp, Artificial Sequence
  Synthesized adaptor olignonucleotide
  misc_feature (34)..(36): n is a, c, g, or t
tgcaggaccagagaattcgaatacacgaccagcnnngatcgacatg

SEQ ID NO: 3297 - DNA, 46 bp, Artificial Sequence
  Synthesized adaptor olignonucleotide
  misc_feature (34)..(36): n is a, c, g, or t
tgcaggaccagagaattcgaatacagccaaaagnnngatcgacatg

SEQ ID NO: 3298 - DNA, 46 bp, Artificial Sequence
  Synthesized adaptor olignonucleotide
  misc_feature (34)..(36): n is a, c, g, or t
tgcaggaccagagaattcgaatacacgaggtaannngatcgacatg

SEQ ID NO: 3299 - DNA, 46 bp, Artificial Sequence
  Synthesized adaptor olignonucleotide
  misc_feature (34)..(36): n is a, c, g, or t
tgcaggaccagagaattcgaatacacagtcatgnnngatcgacatg

SEQ ID NO: 3300 - DNA, 46 bp, Artificial Sequence
  Synthesized adaptor olignonucleotide
  misc_feature (34)..(36): n is a, c, g, or t
tgcaggaccagagaattcgaatacatgaccacannngatcgacatg

SEQ ID NO: 3301 - DNA, 46 bp, Artificial Sequence
  Synthesized adaptor olignonucleotide
  misc_feature (34)..(36): n is a, c, g, or t
tgcaggaccagagaattcgaatacaggaacacannngatcgacatg

SEQ ID NO: 3302 - DNA, 46 bp, Artificial Sequence
  Synthesized adaptor olignonucleotide
  misc_feature (34)..(36): n is a, c, g, or t
tgcaggaccagagaattcgaatacatagtaatcnnngatcgacatg

SEQ ID NO: 3303 - DNA, 46 bp, Artificial Sequence
  Synthesized adaptor olignonucleotide
  misc_feature (34)..(36): n is a, c, g, or t
tgcaggaccagagaattcgaatacaccgacggtnnngatcgacatg

SEQ ID NO: 3304 - DNA, 46 bp, Artificial Sequence
  Synthesized adaptor olignonucleotide
  misc_feature (34)..(36): n is a, c, g, or t
tgcaggaccagagaattcgaatacattgccttgnnngatcgacatg

SEQ ID NO: 3305 - DNA, 46 bp, Artificial Sequence
  Synthesized adaptor olignonucleotide
  misc_feature (34)..(36): n is a, c, g, or t
tgcaggaccagagaattcgaatacagagcggcannngatcgacatg

SEQ ID NO: 3306 - DNA, 46 bp, Artificial Sequence
  Synthesized adaptor olignonucleotide
  misc_feature (34)..(36): n is a, c, g, or t
tgcaggaccagagaattcgaatacaggcctgcannngatcgacatg

SEQ ID NO: 3307 - DNA, 46 bp, Artificial Sequence
  Synthesized adaptor olignonucleotide
  misc_feature (34)..(36): n is a, c, g, or t
tgcaggaccagagaattcgaatacatcgtcaagnnngatcgacatg

SEQ ID NO: 3308 - DNA, 46 bp, Artificial Sequence
  Synthesized adaptor olignonucleotide
  misc_feature (34)..(36): n is a, c, g, or t
tgcaggaccagagaattcgaatacaggacggcannngatcgacatg

SEQ ID NO: 3309 - DNA, 46 bp, Artificial Sequence
  Synthesized adaptor olignonucleotide
  misc_feature (34)..(36): n is a, c, g, or t
tgcaggaccagagaattcgaatacagcatgccgnnntgcatcaggt

SEQ ID NO: 3310 - DNA, 46 bp, Artificial Sequence
  Synthesized adaptor olignonucleotide
  misc_feature (34)..(36): n is a, c, g, or t
tgcaggaccagagaattcgaatacacgtctaagnnntgcatcaggt

SEQ ID NO: 3311 - DNA, 46 bp, Artificial Sequence
  Synthesized adaptor olignonucleotide
  misc_feature (34)..(36): n is a, c, g, or t
tgcaggaccagagaattcgaatacagcgtgattnnntgcatcaggt

SEQ ID NO: 3312 - DNA, 46 bp, Artificial Sequence
  Synthesized adaptor olignonucleotide
  misc_feature (34)..(36): n is a, c, g, or t
tgcaggaccagagaattcgaatacattagtcccnnntgcatcaggt

SEQ ID NO: 3313 - DNA, 46 bp, Artificial Sequence
  Synthesized adaptor olignonucleotide
  misc_feature (34)..(36): n is a, c, g, or t
tgcaggaccagagaattcgaatacatggcattgnnntgcatcaggt

SEQ ID NO: 3314 - DNA, 46 bp, Artificial Sequence
  Synthesized adaptor olignonucleotide
  misc_feature (34)..(36): n is a, c, g, or t
tgcaggaccagagaattcgaatacagacggtggnnntgcatcaggt

SEQ ID NO: 3315 - DNA, 46 bp, Artificial Sequence
  Synthesized adaptor olignonucleotide
  misc_feature (34)..(36): n is a, c, g, or t
tgcaggaccagagaattcgaatacagcgcttttnnntgcatcaggt

SEQ ID NO: 3316 - DNA, 46 bp, Artificial Sequence
  Synthesized adaptor olignonucleotide
  misc_feature (34)..(36): n is a, c, g, or t
tgcaggaccagagaattcgaatacacgtggaccnnntgcatcaggt

SEQ ID NO: 3317 - DNA, 46 bp, Artificial Sequence
  Synthesized adaptor olignonucleotide
  misc_feature (34)..(36): n is a, c, g, or t
tgcaggaccagagaattcgaatacaatgtctttnnntgcatcaggt

SEQ ID NO: 3318 - DNA, 46 bp, Artificial Sequence
  Synthesized adaptor olignonucleotide
  misc_feature (34)..(36): n is a, c, g, or t
tgcaggaccagagaattcgaatacatgaaagcgnnntgcatcaggt

SEQ ID NO: 3319 - DNA, 46 bp, Artificial Sequence
  Synthesized adaptor olignonucleotide
  misc_feature (34)..(36): n is a, c, g, or t
tgcaggaccagagaattcgaatacaccgtgcgannntgcatcaggt

SEQ ID NO: 3320 - DNA, 46 bp, Artificial Sequence
  Synthesized adaptor olignonucleotide
  misc_feature (34)..(36): n is a, c, g, or t
tgcaggaccagagaattcgaatacatacaacatnnntgcatcaggt

SEQ ID NO: 3321 - DNA, 46 bp, Artificial Sequence
  Synthesized adaptor olignonucleotide
  misc_feature (34)..(36): n is a, c, g, or t
tgcaggaccagagaattcgaatacaattactctnnntgcatcaggt

SEQ ID NO: 3322 - DNA, 46 bp, Artificial Sequence
  Synthesized adaptor olignonucleotide
  misc_feature (34)..(36): n is a, c, g, or t
tgcaggaccagagaattcgaatacagttccctannntgcatcaggt

SEQ ID NO: 3323 - DNA, 46 bp, Artificial Sequence
  Synthesized adaptor olignonucleotide
  misc_feature (34)..(36): n is a, c, g, or t
tgcaggaccagagaattcgaatacacacacggcnnntgcatcaggt

SEQ ID NO: 3324 - DNA, 46 bp, Artificial Sequence
  Synthesized adaptor olignonucleotide
  misc_feature (34)..(36): n is a, c, g, or t
tgcaggaccagagaattcgaatacatagaattcnnntgcatcaggt

SEQ ID NO: 3325 - DNA, 46 bp, Artificial Sequence
  Synthesized adaptor olignonucleotide
  misc_feature (34)..(36): n is a, c, g, or t
tgcaggaccagagaattcgaatacagttgaaggnnntgcatcaggt

SEQ ID NO: 3326 - DNA, 46 bp, Artificial Sequence
  Synthesized adaptor olignonucleotide
  misc_feature (34)..(36): n is a, c, g, or t
tgcaggaccagagaattcgaatacacttaacttnnntgcatcaggt

SEQ ID NO: 3327 - DNA, 46 bp, Artificial Sequence
  Synthesized adaptor olignonucleotide
  misc_feature (34)..(36): n is a, c, g, or t
tgcaggaccagagaattcgaatacaacttacccnnntgcatcaggt

SEQ ID NO: 3328 - DNA, 46 bp, Artificial Sequence
  Synthesized adaptor olignonucleotide
  misc_feature (34)..(36): n is a, c, g, or t
tgcaggaccagagaattcgaatacagagttcgtnnntgcatcaggt

SEQ ID NO: 3329 - DNA, 46 bp, Artificial Sequence
  Synthesized adaptor olignonucleotide
  misc_feature (34)..(36): n is a, c, g, or t
tgcaggaccagagaattcgaatacatttccaatnnntgcatcaggt

SEQ ID NO: 3330 - DNA, 46 bp, Artificial Sequence
  Synthesized adaptor olignonucleotide
  misc_feature (34)..(36): n is a, c, g, or t
tgcaggaccagagaattcgaatacaataagttcnnntgcatcaggt

SEQ ID NO: 3331 - DNA, 46 bp, Artificial Sequence
  Synthesized adaptor olignonucleotide
  misc_feature (34)..(36): n is a, c, g, or t
tgcaggaccagagaattcgaatacaaatgtactnnntgcatcaggt

SEQ ID NO: 3332 - DNA, 46 bp, Artificial Sequence
  Synthesized adaptor olignonucleotide
  misc_feature (34)..(36): n is a, c, g, or t
tgcaggaccagagaattcgaatacagtccaagtnnntgcatcaggt

SEQ ID NO: 3333 - DNA, 46 bp, Artificial Sequence
  Synthesized adaptor olignonucleotide
  misc_feature (34)..(36): n is a, c, g, or t
tgcaggaccagagaattcgaatacatcgaccaannntgcatcaggt

SEQ ID NO: 3334 - DNA, 46 bp, Artificial Sequence
  Synthesized adaptor olignonucleotide
  misc_feature (34)..(36): n is a, c, g, or t
tgcaggaccagagaattcgaatacactcgatagnnntgcatcaggt

SEQ ID NO: 3335 - DNA, 46 bp, Artificial Sequence
  Synthesized adaptor olignonucleotide
  misc_feature (34)..(36): n is a, c, g, or t
tgcaggaccagagaattcgaatacaacttcccannntgcatcaggt

SEQ ID NO: 3336 - DNA, 46 bp, Artificial Sequence
  Synthesized adaptor olignonucleotide
  misc_feature (34)..(36): n is a, c, g, or t
tgcaggaccagagaattcgaatacattagattgnnntgcatcaggt

SEQ ID NO: 3337 - DNA, 46 bp, Artificial Sequence
  Synthesized adaptor olignonucleotide
  misc_feature (34)..(36): n is a, c, g, or t
tgcaggaccagagaattcgaatacacattgcgannntgcatcaggt

SEQ ID NO: 3338 - DNA, 46 bp, Artificial Sequence
  Synthesized adaptor olignonucleotide
  misc_feature (34)..(36): n is a, c, g, or t
tgcaggaccagagaattcgaatacacagcacatnnntgcatcaggt

SEQ ID NO: 3339 - DNA, 46 bp, Artificial Sequence
  Synthesized adaptor olignonucleotide
  misc_feature (34)..(36): n is a, c, g, or t
tgcaggaccagagaattcgaatacacccggcaannntgcatcaggt

SEQ ID NO: 3340 - DNA, 46 bp, Artificial Sequence
  Synthesized adaptor olignonucleotide
  misc_feature (34)..(36): n is a, c, g, or t
tgcaggaccagagaattcgaatacaacagatggnnntgcatcaggt

SEQ ID NO: 3341 - DNA, 46 bp, Artificial Sequence
  Synthesized adaptor olignonucleotide
  misc_feature (34)..(36): n is a, c, g, or t
tgcaggaccagagaattcgaatacatgcgtatgnnntgcatcaggt

SEQ ID NO: 3342 - DNA, 46 bp, Artificial Sequence
  Synthesized adaptor olignonucleotide
  misc_feature (34)..(36): n is a, c, g, or t
tgcaggaccagagaattcgaatacaacaggagtnnntgcatcaggt

SEQ ID NO: 3343 - DNA, 46 bp, Artificial Sequence
  Synthesized adaptor olignonucleotide
  misc_feature (34)..(36): n is a, c, g, or t
tgcaggaccagagaattcgaatacacatccatcnnntgcatcaggt

SEQ ID NO: 3344 - DNA, 46 bp, Artificial Sequence
  Synthesized adaptor olignonucleotide
  misc_feature (34)..(36): n is a, c, g, or t
tgcaggaccagagaattcgaatacactacgcccnnntgcatcaggt

SEQ ID NO: 3345 - DNA, 46 bp, Artificial Sequence
  Synthesized adaptor olignonucleotide
  misc_feature (34)..(36): n is a, c, g, or t
tgcaggaccagagaattcgaatacagacctacannntgcatcaggt

SEQ ID NO: 3346 - DNA, 46 bp, Artificial Sequence
  Synthesized adaptor olignonucleotide
  misc_feature (34)..(36): n is a, c, g, or t
tgcaggaccagagaattcgaatacatcccaccgnnntgcatcaggt

SEQ ID NO: 3347 - DNA, 46 bp, Artificial Sequence
  Synthesized adaptor olignonucleotide
  misc_feature (34)..(36): n is a, c, g, or t
tgcaggaccagagaattcgaatacacattcgctnnntgcatcaggt

SEQ ID NO: 3348 - DNA, 46 bp, Artificial Sequence
  Synthesized adaptor olignonucleotide
  misc_feature (34)..(36): n is a, c, g, or t
tgcaggaccagagaattcgaatacagatctggtnnntgcatcaggt

SEQ ID NO: 3349 - DNA, 46 bp, Artificial Sequence
  Synthesized adaptor olignonucleotide
  misc_feature (34)..(36): n is a, c, g, or t
tgcaggaccagagaattcgaatacatatcgtttnnntgcatcaggt

SEQ ID NO: 3350 - DNA, 46 bp, Artificial Sequence
  Synthesized adaptor olignonucleotide
  misc_feature (34)..(36): n is a, c, g, or t
tgcaggaccagagaattcgaatacaggattctgnnntgcatcaggt

SEQ ID NO: 3351 - DNA, 46 bp, Artificial Sequence
  Synthesized adaptor olignonucleotide
  misc_feature (34)..(36): n is a, c, g, or t
tgcaggaccagagaattcgaatacaccgcatccnnntgcatcaggt

SEQ ID NO: 3352 - DNA, 46 bp, Artificial Sequence
  Synthesized adaptor olignonucleotide
  misc_feature (34)..(36): n is a, c, g, or t
tgcaggaccagagaattcgaatacagactaaaannntgcatcaggt

SEQ ID NO: 3353 - DNA, 46 bp, Artificial Sequence
  Synthesized adaptor olignonucleotide
  misc_feature (34)..(36): n is a, c, g, or t
tgcaggaccagagaattcgaatacactggatgtnnntgcatcaggt

SEQ ID NO: 3354 - DNA, 46 bp, Artificial Sequence
  Synthesized adaptor olignonucleotide
  misc_feature (34)..(36): n is a, c, g, or t
tgcaggaccagagaattcgaatacaccgtttacnnntgcatcaggt

SEQ ID NO: 3355 - DNA, 46 bp, Artificial Sequence
  Synthesized adaptor olignonucleotide
  misc_feature (34)..(36): n is a, c, g, or t
tgcaggaccagagaattcgaatacaaattatcgnnntgcatcaggt

SEQ ID NO: 3356 - DNA, 46 bp, Artificial Sequence
  Synthesized adaptor olignonucleotide
  misc_feature (34)..(36): n is a, c, g, or t
tgcaggaccagagaattcgaatacacactcgaannntgcatcaggt

SEQ ID NO: 3357 - DNA, 46 bp, Artificial Sequence
  Synthesized adaptor olignonucleotide
  misc_feature (34)..(36): n is a, c, g, or t
tgcaggaccagagaattcgaatacagaacgttcnnntgcatcaggt

SEQ ID NO: 3358 - DNA, 46 bp, Artificial Sequence
  Synthesized adaptor olignonucleotide
  misc_feature (34)..(36): n is a, c, g, or t
tgcaggaccagagaattcgaatacaacccgcagnnntgcatcaggt

SEQ ID NO: 3359 - DNA, 46 bp, Artificial Sequence
  Synthesized adaptor olignonucleotide
  misc_feature (34)..(36): n is a, c, g, or t
tgcaggaccagagaattcgaatacagtctctgtnnntgcatcaggt

SEQ ID NO: 3360 - DNA, 46 bp, Artificial Sequence
  Synthesized adaptor olignonucleotide
  misc_feature (34)..(36): n is a, c, g, or t
tgcaggaccagagaattcgaatacaattgatcannntgcatcaggt

SEQ ID NO: 3361 - DNA, 46 bp, Artificial Sequence
  Synthesized adaptor olignonucleotide
  misc_feature (34)..(36): n is a, c, g, or t
tgcaggaccagagaattcgaatacaaagtttacnnntgcatcaggt

SEQ ID NO: 3362 - DNA, 46 bp, Artificial Sequence
  Synthesized adaptor olignonucleotide
  misc_feature (34)..(36): n is a, c, g, or t
tgcaggaccagagaattcgaatacatgttgtaannntgcatcaggt

SEQ ID NO: 3363 - DNA, 46 bp, Artificial Sequence
  Synthesized adaptor olignonucleotide
  misc_feature (34)..(36): n is a, c, g, or t
tgcaggaccagagaattcgaatacactctcaacnnntgcatcaggt

SEQ ID NO: 3364 - DNA, 46 bp, Artificial Sequence
  Synthesized adaptor olignonucleotide
  misc_feature (34)..(36): n is a, c, g, or t
tgcaggaccagagaattcgaatacaaacggcccnnntgcatcaggt

SEQ ID NO: 3365 - DNA, 46 bp, Artificial Sequence
  Synthesized adaptor olignonucleotide
  misc_feature (34)..(36): n is a, c, g, or t
tgcaggaccagagaattcgaatacaaatggtaannntgcatcaggt

SEQ ID NO: 3366 - DNA, 46 bp, Artificial Sequence
  Synthesized adaptor olignonucleotide
  misc_feature (34)..(36): n is a, c, g, or t
tgcaggaccagagaattcgaatacatacaaccgnnntgcatcaggt

SEQ ID NO: 3367 - DNA, 46 bp, Artificial Sequence
  Synthesized adaptor olignonucleotide
  misc_feature (34)..(36): n is a, c, g, or t
tgcaggaccagagaattcgaatacaatacggtcnnntgcatcaggt

SEQ ID NO: 3368 - DNA, 46 bp, Artificial Sequence
  Synthesized adaptor olignonucleotide
  misc_feature (34)..(36): n is a, c, g, or t
tgcaggaccagagaattcgaatacatgcgctggnnntgcatcaggt

SEQ ID NO: 3369 - DNA, 46 bp, Artificial Sequence
  Synthesized adaptor olignonucleotide
  misc_feature (34)..(36): n is a, c, g, or t
tgcaggaccagagaattcgaatacagtgtgatcnnnacgtatgcca

SEQ ID NO: 3370 - DNA, 46 bp, Artificial Sequence
  Synthesized adaptor olignonucleotide
  misc_feature (34)..(36): n is a, c, g, or t
tgcaggaccagagaattcgaatacaaaagcgcannnacgtatgcca

SEQ ID NO: 3371 - DNA, 46 bp, Artificial Sequence
  Synthesized adaptor olignonucleotide
  misc_feature (34)..(36): n is a, c, g, or t
tgcaggaccagagaattcgaatacatcgtggatnnnacgtatgcca

SEQ ID NO: 3372 - DNA, 46 bp, Artificial Sequence
  Synthesized adaptor olignonucleotide
  misc_feature (34)..(36): n is a, c, g, or t
tgcaggaccagagaattcgaatacatcaccgaannnacgtatgcca

SEQ ID NO: 3373 - DNA, 46 bp, Artificial Sequence
  Synthesized adaptor olignonucleotide
  misc_feature (34)..(36): n is a, c, g, or t
tgcaggaccagagaattcgaatacagccgttggnnnacgtatgcca

SEQ ID NO: 3374 - DNA, 46 bp, Artificial Sequence
  Synthesized adaptor olignonucleotide
  misc_feature (34)..(36): n is a, c, g, or t
tgcaggaccagagaattcgaatacaacacggttnnnacgtatgcca

SEQ ID NO: 3375 - DNA, 46 bp, Artificial Sequence
  Synthesized adaptor olignonucleotide
  misc_feature (34)..(36): n is a, c, g, or t
tgcaggaccagagaattcgaatacagctcacggnnnacgtatgcca

SEQ ID NO: 3376 - DNA, 46 bp, Artificial Sequence
  Synthesized adaptor olignonucleotide
  misc_feature (34)..(36): n is a, c, g, or t
tgcaggaccagagaattcgaatacacaatcgcannnacgtatgcca

SEQ ID NO: 3377 - DNA, 46 bp, Artificial Sequence
  Synthesized adaptor olignonucleotide
  misc_feature (34)..(36): n is a, c, g, or t
tgcaggaccagagaattcgaatacataatatatnnnacgtatgcca

SEQ ID NO: 3378 - DNA, 46 bp, Artificial Sequence
  Synthesized adaptor olignonucleotide
  misc_feature (34)..(36): n is a, c, g, or t
tgcaggaccagagaattcgaatacacattacccnnnacgtatgcca

SEQ ID NO: 3379 - DNA, 46 bp, Artificial Sequence
  Synthesized adaptor olignonucleotide
  misc_feature (34)..(36): n is a, c, g, or t
tgcaggaccagagaattcgaatacagactactgnnnacgtatgcca

SEQ ID NO: 3380 - DNA, 46 bp, Artificial Sequence
  Synthesized adaptor olignonucleotide
  misc_feature (34)..(36): n is a, c, g, or t
tgcaggaccagagaattcgaatacagtgcacgcnnnacgtatgcca

SEQ ID NO: 3381 - DNA, 46 bp, Artificial Sequence
  Synthesized adaptor olignonucleotide
  misc_feature (34)..(36): n is a, c, g, or t
tgcaggaccagagaattcgaatacaggctattgnnnacgtatgcca

SEQ ID NO: 3382 - DNA, 46 bp, Artificial Sequence
  Synthesized adaptor olignonucleotide
  misc_feature (34)..(36): n is a, c, g, or t
tgcaggaccagagaattcgaatacaggtggtggnnnacgtatgcca

SEQ ID NO: 3383 - DNA, 46 bp, Artificial Sequence
  Synthesized adaptor olignonucleotide
  misc_feature (34)..(36): n is a, c, g, or t
tgcaggaccagagaattcgaatacatgcgtacannnacgtatgcca

SEQ ID NO: 3384 - DNA, 46 bp, Artificial Sequence
  Synthesized adaptor olignonucleotide
  misc_feature (34)..(36): n is a, c, g, or t
tgcaggaccagagaattcgaatacaattcttcannnacgtatgcca

SEQ ID NO: 3385 - DNA, 46 bp, Artificial Sequence
  Synthesized adaptor olignonucleotide
  misc_feature (34)..(36): n is a, c, g, or t
tgcaggaccagagaattcgaatacatctggtctnnnacgtatgcca

SEQ ID NO: 3386 - DNA, 46 bp, Artificial Sequence
  Synthesized adaptor olignonucleotide
  misc_feature (34)..(36): n is a, c, g, or t
tgcaggaccagagaattcgaatacagcgagcctnnnacgtatgcca

SEQ ID NO: 3387 - DNA, 46 bp, Artificial Sequence
  Synthesized adaptor olignonucleotide
  misc_feature (34)..(36): n is a, c, g, or t
tgcaggaccagagaattcgaatacaagccgtgcnnnacgtatgcca

SEQ ID NO: 3388 - DNA, 46 bp, Artificial Sequence
  Synthesized adaptor olignonucleotide
  misc_feature (34)..(36): n is a, c, g, or t
tgcaggaccagagaattcgaatacagataacccnnnacgtatgcca

SEQ ID NO: 3389 - DNA, 46 bp, Artificial Sequence
  Synthesized adaptor olignonucleotide
  misc_feature (34)..(36): n is a, c, g, or t
tgcaggaccagagaattcgaatacacggaacccnnnacgtatgcca

SEQ ID NO: 3390 - DNA, 46 bp, Artificial Sequence
  Synthesized adaptor olignonucleotide
  misc_feature (34)..(36): n is a, c, g, or t
tgcaggaccagagaattcgaatacagtccagcgnnnacgtatgcca

SEQ ID NO: 3391 - DNA, 46 bp, Artificial Sequence
  Synthesized adaptor olignonucleotide
  misc_feature (34)..(36): n is a, c, g, or t
tgcaggaccagagaattcgaatacacgtgagccnnnacgtatgcca

SEQ ID NO: 3392 - DNA, 46 bp, Artificial Sequence
  Synthesized adaptor olignonucleotide
  misc_feature (34)..(36): n is a, c, g, or t
tgcaggaccagagaattcgaatacatcggccagnnnacgtatgcca

SEQ ID NO: 3393 - DNA, 46 bp, Artificial Sequence
  Synthesized adaptor olignonucleotide
  misc_feature (34)..(36): n is a, c, g, or t
tgcaggaccagagaattcgaatacaccgccaagnnnacgtatgcca

SEQ ID NO: 3394 - DNA, 46 bp, Artificial Sequence
  Synthesized adaptor olignonucleotide
  misc_feature (34)..(36): n is a, c, g, or t
tgcaggaccagagaattcgaatacaggctgttannnacgtatgcca

SEQ ID NO: 3395 - DNA, 46 bp, Artificial Sequence
  Synthesized adaptor olignonucleotide
  misc_feature (34)..(36): n is a, c, g, or t
tgcaggaccagagaattcgaatacatgaaaatgnnnacgtatgcca

SEQ ID NO: 3396 - DNA, 46 bp, Artificial Sequence
  Synthesized adaptor olignonucleotide
  misc_feature (34)..(36): n is a, c, g, or t
tgcaggaccagagaattcgaatacacttctatannnacgtatgcca

SEQ ID NO: 3397 - DNA, 46 bp, Artificial Sequence
  Synthesized adaptor olignonucleotide
  misc_feature (34)..(36): n is a, c, g, or t
tgcaggaccagagaattcgaatacatccccgcannnacgtatgcca

SEQ ID NO: 3398 - DNA, 46 bp, Artificial Sequence
  Synthesized adaptor olignonucleotide
  misc_feature (34)..(36): n is a, c, g, or t
tgcaggaccagagaattcgaatacatgtctaccnnnacgtatgcca

SEQ ID NO: 3399 - DNA, 46 bp, Artificial Sequence
  Synthesized adaptor olignonucleotide
  misc_feature (34)..(36): n is a, c, g, or t
tgcaggaccagagaattcgaatacatgtagttannnacgtatgcca

SEQ ID NO: 3400 - DNA, 46 bp, Artificial Sequence
  Synthesized adaptor olignonucleotide
  misc_feature (34)..(36): n is a, c, g, or t
tgcaggaccagagaattcgaatacatggtttaannnacgtatgcca

SEQ ID NO: 3401 - DNA, 46 bp, Artificial Sequence
  Synthesized adaptor olignonucleotide
  misc_feature (34)..(36): n is a, c, g, or t
tgcaggaccagagaattcgaatacagagacggcnnnacgtatgcca

SEQ ID NO: 3402 - DNA, 46 bp, Artificial Sequence
  Synthesized adaptor olignonucleotide
  misc_feature (34)..(36): n is a, c, g, or t
tgcaggaccagagaattcgaatacacgtcgagcnnnacgtatgcca

SEQ ID NO: 3403 - DNA, 46 bp, Artificial Sequence
  Synthesized adaptor olignonucleotide
  misc_feature (34)..(36): n is a, c, g, or t
tgcaggaccagagaattcgaatacacaacagtcnnnacgtatgcca

SEQ ID NO: 3404 - DNA, 46 bp, Artificial Sequence
  Synthesized adaptor olignonucleotide
  misc_feature (34)..(36): n is a, c, g, or t
tgcaggaccagagaattcgaatacatgttgcgannnacgtatgcca

SEQ ID NO: 3405 - DNA, 46 bp, Artificial Sequence
  Synthesized adaptor olignonucleotide
  misc_feature (34)..(36): n is a, c, g, or t
tgcaggaccagagaattcgaatacacgtattttnnnacgtatgcca

SEQ ID NO: 3406 - DNA, 46 bp, Artificial Sequence
  Synthesized adaptor olignonucleotide
  misc_feature (34)..(36): n is a, c, g, or t
tgcaggaccagagaattcgaatacagtacgtcannnacgtatgcca

SEQ ID NO: 3407 - DNA, 46 bp, Artificial Sequence
  Synthesized adaptor olignonucleotide
  misc_feature (34)..(36): n is a, c, g, or t
tgcaggaccagagaattcgaatacacctagcggnnnacgtatgcca

SEQ ID NO: 3408 - DNA, 46 bp, Artificial Sequence
  Synthesized adaptor olignonucleotide
  misc_feature (34)..(36): n is a, c, g, or t
tgcaggaccagagaattcgaatacaagagccggnnnacgtatgcca

SEQ ID NO: 3409 - DNA, 46 bp, Artificial Sequence
  Synthesized adaptor olignonucleotide
  misc_feature (34)..(36): n is a, c, g, or t
tgcaggaccagagaattcgaatacaggcgcccgnnnacgtatgcca

SEQ ID NO: 3410 - DNA, 46 bp, Artificial Sequence
  Synthesized adaptor olignonucleotide
  misc_feature (34)..(36): n is a, c, g, or t
tgcaggaccagagaattcgaatacacagcatgtnnnacgtatgcca

SEQ ID NO: 3411 - DNA, 46 bp, Artificial Sequence
  Synthesized adaptor olignonucleotide
  misc_feature (34)..(36): n is a, c, g, or t
tgcaggaccagagaattcgaatacaagcttaatnnnacgtatgcca

SEQ ID NO: 3412 - DNA, 46 bp, Artificial Sequence
  Synthesized adaptor olignonucleotide
  misc_feature (34)..(36): n is a, c, g, or t
tgcaggaccagagaattcgaatacactcacccgnnnacgtatgcca

SEQ ID NO: 3413 - DNA, 46 bp, Artificial Sequence
  Synthesized adaptor olignonucleotide
  misc_feature (34)..(36): n is a, c, g, or t
tgcaggaccagagaattcgaatacatcggacgcnnnacgtatgcca

SEQ ID NO: 3414 - DNA, 46 bp, Artificial Sequence
  Synthesized adaptor olignonucleotide
  misc_feature (34)..(36): n is a, c, g, or t
tgcaggaccagagaattcgaatacaaactgcgtnnnacgtatgcca

SEQ ID NO: 3415 - DNA, 46 bp, Artificial Sequence
  Synthesized adaptor olignonucleotide
  misc_feature (34)..(36): n is a, c, g, or t
tgcaggaccagagaattcgaatacagcctcctgnnnacgtatgcca

SEQ ID NO: 3416 - DNA, 46 bp, Artificial Sequence
  Synthesized adaptor olignonucleotide
  misc_feature (34)..(36): n is a, c, g, or t
tgcaggaccagagaattcgaatacatagttaacnnnacgtatgcca

SEQ ID NO: 3417 - DNA, 46 bp, Artificial Sequence
  Synthesized adaptor olignonucleotide
  misc_feature (34)..(36): n is a, c, g, or t
tgcaggaccagagaattcgaatacaggacttcannnacgtatgcca

SEQ ID NO: 3418 - DNA, 46 bp, Artificial Sequence
  Synthesized adaptor olignonucleotide
  misc_feature (34)..(36): n is a, c, g, or t
tgcaggaccagagaattcgaatacagccgcatgnnnacgtatgcca

SEQ ID NO: 3419 - DNA, 46 bp, Artificial Sequence
  Synthesized adaptor olignonucleotide
  misc_feature (34)..(36): n is a, c, g, or t
tgcaggaccagagaattcgaatacatggagtagnnnacgtatgcca

SEQ ID NO: 3420 - DNA, 46 bp, Artificial Sequence
  Synthesized adaptor olignonucleotide
  misc_feature (34)..(36): n is a, c, g, or t
tgcaggaccagagaattcgaatacactgttattnnnacgtatgcca

SEQ ID NO: 3421 - DNA, 46 bp, Artificial Sequence
  Synthesized adaptor olignonucleotide
  misc_feature (34)..(36): n is a, c, g, or t
tgcaggaccagagaattcgaatacaaagagcacnnnacgtatgcca

SEQ ID NO: 3422 - DNA, 46 bp, Artificial Sequence
  Synthesized adaptor olignonucleotide
  misc_feature (34)..(36): n is a, c, g, or t
tgcaggaccagagaattcgaatacacgtcgaatnnnacgtatgcca

SEQ ID NO: 3423 - DNA, 46 bp, Artificial Sequence
  Synthesized adaptor olignonucleotide
  misc_feature (34)..(36): n is a, c, g, or t
tgcaggaccagagaattcgaatacactcgtgaannnacgtatgcca

SEQ ID NO: 3424 - DNA, 46 bp, Artificial Sequence
  Synthesized adaptor olignonucleotide
  misc_feature (34)..(36): n is a, c, g, or t
tgcaggaccagagaattcgaatacagatggcaannnacgtatgcca

SEQ ID NO: 3425 - DNA, 46 bp, Artificial Sequence
  Synthesized adaptor olignonucleotide
  misc_feature (34)..(36): n is a, c, g, or t
tgcaggaccagagaattcgaatacataggtggannnacgtatgcca

SEQ ID NO: 3426 - DNA, 46 bp, Artificial Sequence
  Synthesized adaptor olignonucleotide
  misc_feature (34)..(36): n is a, c, g, or t
tgcaggaccagagaattcgaatacagatgactcnnnacgtatgcca

SEQ ID NO: 3427 - DNA, 46 bp, Artificial Sequence
  Synthesized adaptor olignonucleotide
  misc_feature (34)..(36): n is a, c, g, or t
tgcaggaccagagaattcgaatacagctctgttnnnacgtatgcca

SEQ ID NO: 3428 - DNA, 46 bp, Artificial Sequence
  Synthesized adaptor olignonucleotide
  misc_feature (34)..(36): n is a, c, g, or t
tgcaggaccagagaattcgaatacaacgcaactnnnacgtatgcca

SEQ ID NO: 3429 - DNA, 46 bp, Artificial Sequence
  Synthesized adaptor olignonucleotide
  misc_feature (34)..(36): n is a, c, g, or t
tgcaggaccagagaattcgaatacacgaatgctnnnctagcgttac

SEQ ID NO: 3430 - DNA, 46 bp, Artificial Sequence
  Synthesized adaptor olignonucleotide
  misc_feature (34)..(36): n is a, c, g, or t
tgcaggaccagagaattcgaatacaagccaatcnnnctagcgttac

SEQ ID NO: 3431 - DNA, 46 bp, Artificial Sequence
  Synthesized adaptor olignonucleotide
  misc_feature (34)..(36): n is a, c, g, or t
tgcaggaccagagaattcgaatacagcagtttgnnnctagcgttac

SEQ ID NO: 3432 - DNA, 46 bp, Artificial Sequence
  Synthesized adaptor olignonucleotide
  misc_feature (34)..(36): n is a, c, g, or t
tgcaggaccagagaattcgaatacacgcaatgtnnnctagcgttac

SEQ ID NO: 3433 - DNA, 46 bp, Artificial Sequence
  Synthesized adaptor olignonucleotide
  misc_feature (34)..(36): n is a, c, g, or t
tgcaggaccagagaattcgaatacatgcagtgtnnnctagcgttac

SEQ ID NO: 3434 - DNA, 46 bp, Artificial Sequence
  Synthesized adaptor olignonucleotide
  misc_feature (34)..(36): n is a, c, g, or t
tgcaggaccagagaattcgaatacaagtccatgnnnctagcgttac

SEQ ID NO: 3435 - DNA, 46 bp, Artificial Sequence
  Synthesized adaptor olignonucleotide
  misc_feature (34)..(36): n is a, c, g, or t
tgcaggaccagagaattcgaatacactattcatnnnctagcgttac

SEQ ID NO: 3436 - DNA, 46 bp, Artificial Sequence
  Synthesized adaptor olignonucleotide
  misc_feature (34)..(36): n is a, c, g, or t
tgcaggaccagagaattcgaatacagtcgttctnnnctagcgttac

SEQ ID NO: 3437 - DNA, 46 bp, Artificial Sequence
  Synthesized adaptor olignonucleotide
  misc_feature (34)..(36): n is a, c, g, or t
tgcaggaccagagaattcgaatacacgttgtagnnnctagcgttac

SEQ ID NO: 3438 - DNA, 46 bp, Artificial Sequence
  Synthesized adaptor olignonucleotide
  misc_feature (34)..(36): n is a, c, g, or t
tgcaggaccagagaattcgaatacagacagcggnnnctagcgttac

SEQ ID NO: 3439 - DNA, 46 bp, Artificial Sequence
  Synthesized adaptor olignonucleotide
  misc_feature (34)..(36): n is a, c, g, or t
tgcaggaccagagaattcgaatacatacaccctnnnctagcgttac

SEQ ID NO: 3440 - DNA, 46 bp, Artificial Sequence
  Synthesized adaptor olignonucleotide
  misc_feature (34)..(36): n is a, c, g, or t
tgcaggaccagagaattcgaatacacgttaagcnnnctagcgttac

SEQ ID NO: 3441 - DNA, 46 bp, Artificial Sequence
  Synthesized adaptor olignonucleotide
  misc_feature (34)..(36): n is a, c, g, or t
tgcaggaccagagaattcgaatacaatcgccttnnnctagcgttac

SEQ ID NO: 3442 - DNA, 46 bp, Artificial Sequence
  Synthesized adaptor olignonucleotide
  misc_feature (34)..(36): n is a, c, g, or t
tgcaggaccagagaattcgaatacagctatgcannnctagcgttac

SEQ ID NO: 3443 - DNA, 46 bp, Artificial Sequence
  Synthesized adaptor olignonucleotide
  misc_feature (34)..(36): n is a, c, g, or t
tgcaggaccagagaattcgaatacaacgcacgcnnnctagcgttac

SEQ ID NO: 3444 - DNA, 46 bp, Artificial Sequence
  Synthesized adaptor olignonucleotide
  misc_feature (34)..(36): n is a, c, g, or t
tgcaggaccagagaattcgaatacacgtcacaannnctagcgttac

SEQ ID NO: 3445 - DNA, 46 bp, Artificial Sequence
  Synthesized adaptor olignonucleotide
  misc_feature (34)..(36): n is a, c, g, or t
tgcaggaccagagaattcgaatacacgcgatcgnnnctagcgttac

SEQ ID NO: 3446 - DNA, 46 bp, Artificial Sequence
  Synthesized adaptor olignonucleotide
  misc_feature (34)..(36): n is a, c, g, or t
tgcaggaccagagaattcgaatacagttagaccnnnctagcgttac

SEQ ID NO: 3447 - DNA, 46 bp, Artificial Sequence
  Synthesized adaptor olignonucleotide
  misc_feature (34)..(36): n is a, c, g, or t
tgcaggaccagagaattcgaatacatcgcgagcnnnctagcgttac

SEQ ID NO: 3448 - DNA, 46 bp, Artificial Sequence
  Synthesized adaptor olignonucleotide
  misc_feature (34)..(36): n is a, c, g, or t
tgcaggaccagagaattcgaatacatgtaaactnnnctagcgttac

SEQ ID NO: 3449 - DNA, 46 bp, Artificial Sequence
  Synthesized adaptor olignonucleotide
  misc_feature (34)..(36): n is a, c, g, or t
tgcaggaccagagaattcgaatacatgccatagnnnctagcgttac

SEQ ID NO: 3450 - DNA, 46 bp, Artificial Sequence
  Synthesized adaptor olignonucleotide
  misc_feature (34)..(36): n is a, c, g, or t
tgcaggaccagagaattcgaatacataattacgnnnctagcgttac

SEQ ID NO: 3451 - DNA, 46 bp, Artificial Sequence
  Synthesized adaptor olignonucleotide
  misc_feature (34)..(36): n is a, c, g, or t
tgcaggaccagagaattcgaatacacccgcgccnnnctagcgttac

SEQ ID NO: 3452 - DNA, 46 bp, Artificial Sequence
  Synthesized adaptor olignonucleotide
  misc_feature (34)..(36): n is a, c, g, or t
tgcaggaccagagaattcgaatacacaatatcannnctagcgttac

SEQ ID NO: 3453 - DNA, 46 bp, Artificial Sequence
  Synthesized adaptor olignonucleotide
  misc_feature (34)..(36): n is a, c, g, or t
tgcaggaccagagaattcgaatacaattaaggannnctagcgttac

SEQ ID NO: 3454 - DNA, 46 bp, Artificial Sequence
  Synthesized adaptor olignonucleotide
  misc_feature (34)..(36): n is a, c, g, or t
tgcaggaccagagaattcgaatacaatatacacnnnctagcgttac

SEQ ID NO: 3455 - DNA, 46 bp, Artificial Sequence
  Synthesized adaptor olignonucleotide
  misc_feature (34)..(36): n is a, c, g, or t
tgcaggaccagagaattcgaatacatattgacannnctagcgttac

SEQ ID NO: 3456 - DNA, 46 bp, Artificial Sequence
  Synthesized adaptor olignonucleotide
  misc_feature (34)..(36): n is a, c, g, or t
tgcaggaccagagaattcgaatacaacgaaaatnnnctagcgttac

SEQ ID NO: 3457 - DNA, 46 bp, Artificial Sequence
  Synthesized adaptor olignonucleotide
  misc_feature (34)..(36): n is a, c, g, or t
tgcaggaccagagaattcgaatacagtaggacannnctagcgttac

SEQ ID NO: 3458 - DNA, 46 bp, Artificial Sequence
  Synthesized adaptor olignonucleotide
  misc_feature (34)..(36): n is a, c, g, or t
tgcaggaccagagaattcgaatacacccccagtnnnctagcgttac

SEQ ID NO: 3459 - DNA, 46 bp, Artificial Sequence
  Synthesized adaptor olignonucleotide
  misc_feature (34)..(36): n is a, c, g, or t
tgcaggaccagagaattcgaatacacctacgttnnnctagcgttac

SEQ ID NO: 3460 - DNA, 46 bp, Artificial Sequence
  Synthesized adaptor olignonucleotide
  misc_feature (34)..(36): n is a, c, g, or t
tgcaggaccagagaattcgaatacatggtgagannnctagcgttac

SEQ ID NO: 3461 - DNA, 46 bp, Artificial Sequence
  Synthesized adaptor olignonucleotide
  misc_feature (34)..(36): n is a, c, g, or t
tgcaggaccagagaattcgaatacactagcacannnctagcgttac

SEQ ID NO: 3462 - DNA, 46 bp, Artificial Sequence
  Synthesized adaptor olignonucleotide
  misc_feature (34)..(36): n is a, c, g, or t
tgcaggaccagagaattcgaatacatcatgtaannnctagcgttac

SEQ ID NO: 3463 - DNA, 46 bp, Artificial Sequence
  Synthesized adaptor olignonucleotide
  misc_feature (34)..(36): n is a, c, g, or t
tgcaggaccagagaattcgaatacaggacgaatnnnctagcgttac

SEQ ID NO: 3464 - DNA, 46 bp, Artificial Sequence
  Synthesized adaptor olignonucleotide
  misc_feature (34)..(36): n is a, c, g, or t
tgcaggaccagagaattcgaatacaggatggcgnnnctagcgttac

SEQ ID NO: 3465 - DNA, 46 bp, Artificial Sequence
  Synthesized adaptor olignonucleotide
  misc_feature (34)..(36): n is a, c, g, or t
tgcaggaccagagaattcgaatacatcccagttnnnctagcgttac

SEQ ID NO: 3466 - DNA, 46 bp, Artificial Sequence
  Synthesized adaptor olignonucleotide
  misc_feature (34)..(36): n is a, c, g, or t
tgcaggaccagagaattcgaatacacgagacaannnctagcgttac

SEQ ID NO: 3467 - DNA, 46 bp, Artificial Sequence
  Synthesized adaptor olignonucleotide
  misc_feature (34)..(36): n is a, c, g, or t
tgcaggaccagagaattcgaatacacaataccgnnnctagcgttac

SEQ ID NO: 3468 - DNA, 46 bp, Artificial Sequence
  Synthesized adaptor olignonucleotide
  misc_feature (34)..(36): n is a, c, g, or t
tgcaggaccagagaattcgaatacatttatgtcnnnctagcgttac

SEQ ID NO: 3469 - DNA, 46 bp, Artificial Sequence
  Synthesized adaptor olignonucleotide
  misc_feature (34)..(36): n is a, c, g, or t
tgcaggaccagagaattcgaatacatggtaaccnnnctagcgttac

SEQ ID NO: 3470 - DNA, 46 bp, Artificial Sequence
  Synthesized adaptor olignonucleotide
  misc_feature (34)..(36): n is a, c, g, or t
tgcaggaccagagaattcgaatacaagcccatannnctagcgttac

SEQ ID NO: 3471 - DNA, 46 bp, Artificial Sequence
  Synthesized adaptor olignonucleotide
  misc_feature (34)..(36): n is a, c, g, or t
tgcaggaccagagaattcgaatacaatcctccannnctagcgttac

SEQ ID NO: 3472 - DNA, 46 bp, Artificial Sequence
  Synthesized adaptor olignonucleotide
  misc_feature (34)..(36): n is a, c, g, or t
tgcaggaccagagaattcgaatacatttttgacnnnctagcgttac

SEQ ID NO: 3473 - DNA, 46 bp, Artificial Sequence
  Synthesized adaptor olignonucleotide
  misc_feature (34)..(36): n is a, c, g, or t
tgcaggaccagagaattcgaatacaatagcctgnnnctagcgttac

SEQ ID NO: 3474 - DNA, 46 bp, Artificial Sequence
  Synthesized adaptor olignonucleotide
  misc_feature (34)..(36): n is a, c, g, or t
tgcaggaccagagaattcgaatacaggagtcttnnnctagcgttac

SEQ ID NO: 3475 - DNA, 46 bp, Artificial Sequence
  Synthesized adaptor olignonucleotide
  misc_feature (34)..(36): n is a, c, g, or t
tgcaggaccagagaattcgaatacaaccccaccnnnctagcgttac

SEQ ID NO: 3476 - DNA, 46 bp, Artificial Sequence
  Synthesized adaptor olignonucleotide
  misc_feature (34)..(36): n is a, c, g, or t
tgcaggaccagagaattcgaatacacgcggcatnnnctagcgttac

SEQ ID NO: 3477 - DNA, 46 bp, Artificial Sequence
  Synthesized adaptor olignonucleotide
  misc_feature (34)..(36): n is a, c, g, or t
tgcaggaccagagaattcgaatacatccagacannnctagcgttac

SEQ ID NO: 3478 - DNA, 46 bp, Artificial Sequence
  Synthesized adaptor olignonucleotide
  misc_feature (34)..(36): n is a, c, g, or t
tgcaggaccagagaattcgaatacaaaatgcaannnctagcgttac

SEQ ID NO: 3479 - DNA, 46 bp, Artificial Sequence
  Synthesized adaptor olignonucleotide
  misc_feature (34)..(36): n is a, c, g, or t
tgcaggaccagagaattcgaatacaaattcgcgnnnctagcgttac

SEQ ID NO: 3480 - DNA, 46 bp, Artificial Sequence
  Synthesized adaptor olignonucleotide
  misc_feature (34)..(36): n is a, c, g, or t
tgcaggaccagagaattcgaatacagtgtccttnnnctagcgttac

SEQ ID NO: 3481 - DNA, 46 bp, Artificial Sequence
  Synthesized adaptor olignonucleotide
  misc_feature (34)..(36): n is a, c, g, or t
tgcaggaccagagaattcgaatacacatgtaatnnnctagcgttac

SEQ ID NO: 3482 - DNA, 46 bp, Artificial Sequence
  Synthesized adaptor olignonucleotide
  misc_feature (34)..(36): n is a, c, g, or t
tgcaggaccagagaattcgaatacaacgcatacnnnctagcgttac

SEQ ID NO: 3483 - DNA, 46 bp, Artificial Sequence
  Synthesized adaptor olignonucleotide
  misc_feature (34)..(36): n is a, c, g, or t
tgcaggaccagagaattcgaatacaatgcccccnnnctagcgttac

SEQ ID NO: 3484 - DNA, 46 bp, Artificial Sequence
  Synthesized adaptor olignonucleotide
  misc_feature (34)..(36): n is a, c, g, or t
tgcaggaccagagaattcgaatacactccccagnnnctagcgttac

SEQ ID NO: 3485 - DNA, 46 bp, Artificial Sequence
  Synthesized adaptor olignonucleotide
  misc_feature (34)..(36): n is a, c, g, or t
tgcaggaccagagaattcgaatacatctacttannnctagcgttac

SEQ ID NO: 3486 - DNA, 46 bp, Artificial Sequence
  Synthesized adaptor olignonucleotide
  misc_feature (34)..(36): n is a, c, g, or t
tgcaggaccagagaattcgaatacataccggtannnctagcgttac

SEQ ID NO: 3487 - DNA, 46 bp, Artificial Sequence
  Synthesized adaptor olignonucleotide
  misc_feature (34)..(36): n is a, c, g, or t
tgcaggaccagagaattcgaatacaaacctatannnctagcgttac

SEQ ID NO: 3488 - DNA, 46 bp, Artificial Sequence
  Synthesized adaptor olignonucleotide
  misc_feature (34)..(36): n is a, c, g, or t
tgcaggaccagagaattcgaatacagcgactgcnnnctagcgttac

SEQ ID NO: 3489 - DNA, 46 bp, Artificial Sequence
  Synthesized adaptor olignonucleotide
  misc_feature (34)..(36): n is a, c, g, or t
tgcaggaccagagaattcgaatacacgagtctannngatcgacatg

SEQ ID NO: 3490 - DNA, 46 bp, Artificial Sequence
  Synthesized adaptor olignonucleotide
  misc_feature (34)..(36): n is a, c, g, or t
tgcaggaccagagaattcgaatacatatgaaagnnngatcgacatg

SEQ ID NO: 3491 - DNA, 46 bp, Artificial Sequence
  Synthesized adaptor olignonucleotide
  misc_feature (34)..(36): n is a, c, g, or t
tgcaggaccagagaattcgaatacaactggccgnnngatcgacatg

SEQ ID NO: 3492 - DNA, 46 bp, Artificial Sequence
  Synthesized adaptor olignonucleotide
  misc_feature (34)..(36): n is a, c, g, or t
tgcaggaccagagaattcgaatacacaaccatgnnngatcgacatg

SEQ ID NO: 3493 - DNA, 46 bp, Artificial Sequence
  Synthesized adaptor olignonucleotide
  misc_feature (34)..(36): n is a, c, g, or t
tgcaggaccagagaattcgaatacaaaggtagcnnngatcgacatg

SEQ ID NO: 3494 - DNA, 46 bp, Artificial Sequence
  Synthesized adaptor olignonucleotide
  misc_feature (34)..(36): n is a, c, g, or t
tgcaggaccagagaattcgaatacattctcagcnnngatcgacatg

SEQ ID NO: 3495 - DNA, 46 bp, Artificial Sequence
  Synthesized adaptor olignonucleotide
  misc_feature (34)..(36): n is a, c, g, or t
tgcaggaccagagaattcgaatacattcaggtgnnngatcgacatg

SEQ ID NO: 3496 - DNA, 46 bp, Artificial Sequence
  Synthesized adaptor olignonucleotide
  misc_feature (34)..(36): n is a, c, g, or t
tgcaggaccagagaattcgaatacaccaatcctnnngatcgacatg

SEQ ID NO: 3497 - DNA, 46 bp, Artificial Sequence
  Synthesized adaptor olignonucleotide
  misc_feature (34)..(36): n is a, c, g, or t
tgcaggaccagagaattcgaatacagacagttcnnngatcgacatg

SEQ ID NO: 3498 - DNA, 46 bp, Artificial Sequence
  Synthesized adaptor olignonucleotide
  misc_feature (34)..(36): n is a, c, g, or t
tgcaggaccagagaattcgaatacaatctttacnnngatcgacatg

SEQ ID NO: 3499 - DNA, 46 bp, Artificial Sequence
  Synthesized adaptor olignonucleotide
  misc_feature (34)..(36): n is a, c, g, or t
tgcaggaccagagaattcgaatacagcaatattnnngatcgacatg

SEQ ID NO: 3500 - DNA, 46 bp, Artificial Sequence
  Synthesized adaptor olignonucleotide
  misc_feature (34)..(36): n is a, c, g, or t
tgcaggaccagagaattcgaatacagtctccatnnngatcgacatg

SEQ ID NO: 3501 - DNA, 46 bp, Artificial Sequence
  Synthesized adaptor olignonucleotide
  misc_feature (34)..(36): n is a, c, g, or t
tgcaggaccagagaattcgaatacacaacaattnnngatcgacatg

SEQ ID NO: 3502 - DNA, 46 bp, Artificial Sequence
  Synthesized adaptor olignonucleotide
  misc_feature (34)..(36): n is a, c, g, or t
tgcaggaccagagaattcgaatacatcgtagacnnngatcgacatg

SEQ ID NO: 3503 - DNA, 46 bp, Artificial Sequence
  Synthesized adaptor olignonucleotide
  misc_feature (34)..(36): n is a, c, g, or t
tgcaggaccagagaattcgaatacagtagataannngatcgacatg

SEQ ID NO: 3504 - DNA, 46 bp, Artificial Sequence
  Synthesized adaptor olignonucleotide
  misc_feature (34)..(36): n is a, c, g, or t
tgcaggaccagagaattcgaatacaacatatacnnngatcgacatg

SEQ ID NO: 3505 - DNA, 46 bp, Artificial Sequence
  Synthesized adaptor olignonucleotide
  misc_feature (34)..(36): n is a, c, g, or t
tgcaggaccagagaattcgaatacacacgacgcnnngatcgacatg

SEQ ID NO: 3506 - DNA, 46 bp, Artificial Sequence
  Synthesized adaptor olignonucleotide
  misc_feature (34)..(36): n is a, c, g, or t
tgcaggaccagagaattcgaatacacacaaaaannngatcgacatg

SEQ ID NO: 3507 - DNA, 46 bp, Artificial Sequence
  Synthesized adaptor olignonucleotide
  misc_feature (34)..(36): n is a, c, g, or t
tgcaggaccagagaattcgaatacacgtaccggnnngatcgacatg

SEQ ID NO: 3508 - DNA, 46 bp, Artificial Sequence
  Synthesized adaptor olignonucleotide
  misc_feature (34)..(36): n is a, c, g, or t
tgcaggaccagagaattcgaatacaccacaatgnnngatcgacatg

SEQ ID NO: 3509 - DNA, 46 bp, Artificial Sequence
  Synthesized adaptor olignonucleotide
  misc_feature (34)..(36): n is a, c, g, or t
tgcaggaccagagaattcgaatacacgctctgcnnngatcgacatg

SEQ ID NO: 3510 - DNA, 46 bp, Artificial Sequence
  Synthesized adaptor olignonucleotide
  misc_feature (34)..(36): n is a, c, g, or t
tgcaggaccagagaattcgaatacagtcaagctnnngatcgacatg

SEQ ID NO: 3511 - DNA, 46 bp, Artificial Sequence
  Synthesized adaptor olignonucleotide
  misc_feature (34)..(36): n is a, c, g, or t
tgcaggaccagagaattcgaatacaactcttcgnnngatcgacatg

SEQ ID NO: 3512 - DNA, 46 bp, Artificial Sequence
  Synthesized adaptor olignonucleotide
  misc_feature (34)..(36): n is a, c, g, or t
tgcaggaccagagaattcgaatacaaacacggannngatcgacatg

SEQ ID NO: 3513 - DNA, 46 bp, Artificial Sequence
  Synthesized adaptor olignonucleotide
  misc_feature (34)..(36): n is a, c, g, or t
tgcaggaccagagaattcgaatacaaccgcgcannngatcgacatg

SEQ ID NO: 3514 - DNA, 46 bp, Artificial Sequence
  Synthesized adaptor olignonucleotide
  misc_feature (34)..(36): n is a, c, g, or t
tgcaggaccagagaattcgaatacacaccttgtnnngatcgacatg

SEQ ID NO: 3515 - DNA, 46 bp, Artificial Sequence
  Synthesized adaptor olignonucleotide
  misc_feature (34)..(36): n is a, c, g, or t
tgcaggaccagagaattcgaatacattatgcggnnngatcgacatg

SEQ ID NO: 3516 - DNA, 46 bp, Artificial Sequence
  Synthesized adaptor olignonucleotide
  misc_feature (34)..(36): n is a, c, g, or t
tgcaggaccagagaattcgaatacagactcttcnnngatcgacatg

SEQ ID NO: 3517 - DNA, 46 bp, Artificial Sequence
  Synthesized adaptor olignonucleotide
  misc_feature (34)..(36): n is a, c, g, or t
tgcaggaccagagaattcgaatacagagtcttgnnngatcgacatg

SEQ ID NO: 3518 - DNA, 46 bp, Artificial Sequence
  Synthesized adaptor olignonucleotide
  misc_feature (34)..(36): n is a, c, g, or t
tgcaggaccagagaattcgaatacatagaatctnnngatcgacatg

SEQ ID NO: 3519 - DNA, 46 bp, Artificial Sequence
  Synthesized adaptor olignonucleotide
  misc_feature (34)..(36): n is a, c, g, or t
tgcaggaccagagaattcgaatacacgaccacgnnngatcgacatg

SEQ ID NO: 3520 - DNA, 46 bp, Artificial Sequence
  Synthesized adaptor olignonucleotide
  misc_feature (34)..(36): n is a, c, g, or t
tgcaggaccagagaattcgaatacatggattcgnnngatcgacatg

SEQ ID NO: 3521 - DNA, 46 bp, Artificial Sequence
  Synthesized adaptor olignonucleotide
  misc_feature (34)..(36): n is a, c, g, or t
tgcaggaccagagaattcgaatacacgactagtnnngatcgacatg

SEQ ID NO: 3522 - DNA, 46 bp, Artificial Sequence
  Synthesized adaptor olignonucleotide
  misc_feature (34)..(36): n is a, c, g, or t
tgcaggaccagagaattcgaatacacccaaaacnnngatcgacatg

SEQ ID NO: 3523 - DNA, 46 bp, Artificial Sequence
  Synthesized adaptor olignonucleotide
  misc_feature (34)..(36): n is a, c, g, or t
tgcaggaccagagaattcgaatacatgacccccnnngatcgacatg

SEQ ID NO: 3524 - DNA, 46 bp, Artificial Sequence
  Synthesized adaptor olignonucleotide
  misc_feature (34)..(36): n is a, c, g, or t
tgcaggaccagagaattcgaatacagcattagcnnngatcgacatg

SEQ ID NO: 3525 - DNA, 46 bp, Artificial Sequence
  Synthesized adaptor olignonucleotide
  misc_feature (34)..(36): n is a, c, g, or t
tgcaggaccagagaattcgaatacagccagattnnngatcgacatg

SEQ ID NO: 3526 - DNA, 46 bp, Artificial Sequence
  Synthesized adaptor olignonucleotide
  misc_feature (34)..(36): n is a, c, g, or t
tgcaggaccagagaattcgaatacaacaactatnnngatcgacatg

SEQ ID NO: 3527 - DNA, 46 bp, Artificial Sequence
  Synthesized adaptor olignonucleotide
  misc_feature (34)..(36): n is a, c, g, or t
tgcaggaccagagaattcgaatacagtaggtctnnngatcgacatg

SEQ ID NO: 3528 - DNA, 46 bp, Artificial Sequence
  Synthesized adaptor olignonucleotide
  misc_feature (34)..(36): n is a, c, g, or t
tgcaggaccagagaattcgaatacaaataaggtnnngatcgacatg

SEQ ID NO: 3529 - DNA, 46 bp, Artificial Sequence
  Synthesized adaptor olignonucleotide
  misc_feature (34)..(36): n is a, c, g, or t
tgcaggaccagagaattcgaatacaaagagaaannngatcgacatg

SEQ ID NO: 3530 - DNA, 46 bp, Artificial Sequence
  Synthesized adaptor olignonucleotide
  misc_feature (34)..(36): n is a, c, g, or t
tgcaggaccagagaattcgaatacattttgtgtnnngatcgacatg

SEQ ID NO: 3531 - DNA, 46 bp, Artificial Sequence
  Synthesized adaptor olignonucleotide
  misc_feature (34)..(36): n is a, c, g, or t
tgcaggaccagagaattcgaatacaaggcgtttnnngatcgacatg

SEQ ID NO: 3532 - DNA, 46 bp, Artificial Sequence
  Synthesized adaptor olignonucleotide
  misc_feature (34)..(36): n is a, c, g, or t
tgcaggaccagagaattcgaatacaaaaagctannngatcgacatg

SEQ ID NO: 3533 - DNA, 46 bp, Artificial Sequence
  Synthesized adaptor olignonucleotide
  misc_feature (34)..(36): n is a, c, g, or t
tgcaggaccagagaattcgaatacaaccggattnnngatcgacatg

SEQ ID NO: 3534 - DNA, 46 bp, Artificial Sequence
  Synthesized adaptor olignonucleotide
  misc_feature (34)..(36): n is a, c, g, or t
tgcaggaccagagaattcgaatacactcaaatannngatcgacatg

SEQ ID NO: 3535 - DNA, 46 bp, Artificial Sequence
  Synthesized adaptor olignonucleotide
  misc_feature (34)..(36): n is a, c, g, or t
tgcaggaccagagaattcgaatacacgagaacannngatcgacatg

SEQ ID NO: 3536 - DNA, 46 bp, Artificial Sequence
  Synthesized adaptor olignonucleotide
  misc_feature (34)..(36): n is a, c, g, or t
tgcaggaccagagaattcgaatacacccaggacnnngatcgacatg

SEQ ID NO: 3537 - DNA, 46 bp, Artificial Sequence
  Synthesized adaptor olignonucleotide
  misc_feature (34)..(36): n is a, c, g, or t
tgcaggaccagagaattcgaatacaccagctccnnngatcgacatg

SEQ ID NO: 3538 - DNA, 46 bp, Artificial Sequence
  Synthesized adaptor olignonucleotide
  misc_feature (34)..(36): n is a, c, g, or t
tgcaggaccagagaattcgaatacatatacatgnnngatcgacatg

SEQ ID NO: 3539 - DNA, 46 bp, Artificial Sequence
  Synthesized adaptor olignonucleotide
  misc_feature (34)..(36): n is a, c, g, or t
tgcaggaccagagaattcgaatacatatagttgnnngatcgacatg

SEQ ID NO: 3540 - DNA, 46 bp, Artificial Sequence
  Synthesized adaptor olignonucleotide
  misc_feature (34)..(36): n is a, c, g, or t
tgcaggaccagagaattcgaatacacatagttannngatcgacatg

SEQ ID NO: 3541 - DNA, 46 bp, Artificial Sequence
  Synthesized adaptor olignonucleotide
  misc_feature (34)..(36): n is a, c, g, or t
tgcaggaccagagaattcgaatacattcattacnnngatcgacatg

SEQ ID NO: 3542 - DNA, 46 bp, Artificial Sequence
  Synthesized adaptor olignonucleotide
  misc_feature (34)..(36): n is a, c, g, or t
tgcaggaccagagaattcgaatacatgctacctnnngatcgacatg

SEQ ID NO: 3543 - DNA, 46 bp, Artificial Sequence
  Synthesized adaptor olignonucleotide
  misc_feature (34)..(36): n is a, c, g, or t
tgcaggaccagagaattcgaatacagtagcttgnnngatcgacatg

SEQ ID NO: 3544 - DNA, 46 bp, Artificial Sequence
  Synthesized adaptor olignonucleotide
  misc_feature (34)..(36): n is a, c, g, or t
tgcaggaccagagaattcgaatacaccggatatnnngatcgacatg

SEQ ID NO: 3545 - DNA, 46 bp, Artificial Sequence
  Synthesized adaptor olignonucleotide
  misc_feature (34)..(36): n is a, c, g, or t
tgcaggaccagagaattcgaatacacagccgcannngatcgacatg

SEQ ID NO: 3546 - DNA, 46 bp, Artificial Sequence
  Synthesized adaptor olignonucleotide
  misc_feature (34)..(36): n is a, c, g, or t
tgcaggaccagagaattcgaatacagatcctctnnngatcgacatg

SEQ ID NO: 3547 - DNA, 46 bp, Artificial Sequence
  Synthesized adaptor olignonucleotide
  misc_feature (34)..(36): n is a, c, g, or t
tgcaggaccagagaattcgaatacaagtacccannngatcgacatg

SEQ ID NO: 3548 - DNA, 46 bp, Artificial Sequence
  Synthesized adaptor olignonucleotide
  misc_feature (34)..(36): n is a, c, g, or t
tgcaggaccagagaattcgaatacaacggagtannngatcgacatg

SEQ ID NO: 3549 - DNA, 46 bp, Artificial Sequence
  Synthesized adaptor olignonucleotide
  misc_feature (34)..(36): n is a, c, g, or t
tgcaggaccagagaattcgaatacagtaaaagtnnntgcatcaggt

SEQ ID NO: 3550 - DNA, 46 bp, Artificial Sequence
  Synthesized adaptor olignonucleotide
  misc_feature (34)..(36): n is a, c, g, or t
tgcaggaccagagaattcgaatacataggtgtcnnntgcatcaggt

SEQ ID NO: 3551 - DNA, 46 bp, Artificial Sequence
  Synthesized adaptor olignonucleotide
  misc_feature (34)..(36): n is a, c, g, or t
tgcaggaccagagaattcgaatacatagaccgtnnntgcatcaggt

SEQ ID NO: 3552 - DNA, 46 bp, Artificial Sequence
  Synthesized adaptor olignonucleotide
  misc_feature (34)..(36): n is a, c, g, or t
tgcaggaccagagaattcgaatacagctcgtttnnntgcatcaggt

SEQ ID NO: 3553 - DNA, 46 bp, Artificial Sequence
  Synthesized adaptor olignonucleotide
  misc_feature (34)..(36): n is a, c, g, or t
tgcaggaccagagaattcgaatacaaaatcttgnnntgcatcaggt

SEQ ID NO: 3554 - DNA, 46 bp, Artificial Sequence
  Synthesized adaptor olignonucleotide
  misc_feature (34)..(36): n is a, c, g, or t
tgcaggaccagagaattcgaatacagaccaactnnntgcatcaggt

SEQ ID NO: 3555 - DNA, 46 bp, Artificial Sequence
  Synthesized adaptor olignonucleotide
  misc_feature (34)..(36): n is a, c, g, or t
tgcaggaccagagaattcgaatacatcacctacnnntgcatcaggt

SEQ ID NO: 3556 - DNA, 46 bp, Artificial Sequence
  Synthesized adaptor olignonucleotide
  misc_feature (34)..(36): n is a, c, g, or t
tgcaggaccagagaattcgaatacagttaattgnnntgcatcaggt

SEQ ID NO: 3557 - DNA, 46 bp, Artificial Sequence
  Synthesized adaptor olignonucleotide
  misc_feature (34)..(36): n is a, c, g, or t
tgcaggaccagagaattcgaatacagcaattatnnntgcatcaggt

SEQ ID NO: 3558 - DNA, 46 bp, Artificial Sequence
  Synthesized adaptor olignonucleotide
  misc_feature (34)..(36): n is a, c, g, or t
tgcaggaccagagaattcgaatacaaacgagacnnntgcatcaggt

SEQ ID NO: 3559 - DNA, 46 bp, Artificial Sequence
  Synthesized adaptor olignonucleotide
  misc_feature (34)..(36): n is a, c, g, or t
tgcaggaccagagaattcgaatacaatcggcatnnntgcatcaggt

SEQ ID NO: 3560 - DNA, 46 bp, Artificial Sequence
  Synthesized adaptor olignonucleotide
  misc_feature (34)..(36): n is a, c, g, or t
tgcaggaccagagaattcgaatacaccacacggnnntgcatcaggt

SEQ ID NO: 3561 - DNA, 46 bp, Artificial Sequence
  Synthesized adaptor olignonucleotide
  misc_feature (34)..(36): n is a, c, g, or t
tgcaggaccagagaattcgaatacaggccaggannntgcatcaggt

SEQ ID NO: 3562 - DNA, 46 bp, Artificial Sequence
  Synthesized adaptor olignonucleotide
  misc_feature (34)..(36): n is a, c, g, or t
tgcaggaccagagaattcgaatacagaggagttnnntgcatcaggt

SEQ ID NO: 3563 - DNA, 46 bp, Artificial Sequence
  Synthesized adaptor olignonucleotide
  misc_feature (34)..(36): n is a, c, g, or t
tgcaggaccagagaattcgaatacaccaccgctnnntgcatcaggt

SEQ ID NO: 3564 - DNA, 46 bp, Artificial Sequence
  Synthesized adaptor olignonucleotide
  misc_feature (34)..(36): n is a, c, g, or t
tgcaggaccagagaattcgaatacaacgatgagnnntgcatcaggt

SEQ ID NO: 3565 - DNA, 46 bp, Artificial Sequence
  Synthesized adaptor olignonucleotide
  misc_feature (34)..(36): n is a, c, g, or t
tgcaggaccagagaattcgaatacattagcatannntgcatcaggt

SEQ ID NO: 3566 - DNA, 46 bp, Artificial Sequence
  Synthesized adaptor olignonucleotide
  misc_feature (34)..(36): n is a, c, g, or t
tgcaggaccagagaattcgaatacaagtcccaannntgcatcaggt

SEQ ID NO: 3567 - DNA, 46 bp, Artificial Sequence
  Synthesized adaptor olignonucleotide
  misc_feature (34)..(36): n is a, c, g, or t
tgcaggaccagagaattcgaatacaagcctcttnnntgcatcaggt

SEQ ID NO: 3568 - DNA, 46 bp, Artificial Sequence
  Synthesized adaptor olignonucleotide
  misc_feature (34)..(36): n is a, c, g, or t
tgcaggaccagagaattcgaatacatcaccatcnnntgcatcaggt

SEQ ID NO: 3569 - DNA, 46 bp, Artificial Sequence
  Synthesized adaptor olignonucleotide
  misc_feature (34)..(36): n is a, c, g, or t
tgcaggaccagagaattcgaatacactcatcacnnntgcatcaggt

SEQ ID NO: 3570 - DNA, 46 bp, Artificial Sequence
  Synthesized adaptor olignonucleotide
  misc_feature (34)..(36): n is a, c, g, or t
tgcaggaccagagaattcgaatacaacggcgagnnntgcatcaggt

SEQ ID NO: 3571 - DNA, 46 bp, Artificial Sequence
  Synthesized adaptor olignonucleotide
  misc_feature (34)..(36): n is a, c, g, or t
tgcaggaccagagaattcgaatacactcggacgnnntgcatcaggt

SEQ ID NO: 3572 - DNA, 46 bp, Artificial Sequence
  Synthesized adaptor olignonucleotide
  misc_feature (34)..(36): n is a, c, g, or t
tgcaggaccagagaattcgaatacatacggcatnnntgcatcaggt

SEQ ID NO: 3573 - DNA, 46 bp, Artificial Sequence
  Synthesized adaptor olignonucleotide
  misc_feature (34)..(36): n is a, c, g, or t
tgcaggaccagagaattcgaatacatttagtagnnntgcatcaggt

SEQ ID NO: 3574 - DNA, 46 bp, Artificial Sequence
  Synthesized adaptor olignonucleotide
  misc_feature (34)..(36): n is a, c, g, or t
tgcaggaccagagaattcgaatacaaggaagagnnntgcatcaggt

SEQ ID NO: 3575 - DNA, 46 bp, Artificial Sequence
  Synthesized adaptor olignonucleotide
  misc_feature (34)..(36): n is a, c, g, or t
tgcaggaccagagaattcgaatacaccgcgcaannntgcatcaggt

SEQ ID NO: 3576 - DNA, 46 bp, Artificial Sequence
  Synthesized adaptor olignonucleotide
  misc_feature (34)..(36): n is a, c, g, or t
tgcaggaccagagaattcgaatacagtcgtggcnnntgcatcaggt

SEQ ID NO: 3577 - DNA, 46 bp, Artificial Sequence
  Synthesized adaptor olignonucleotide
  misc_feature (34)..(36): n is a, c, g, or t
tgcaggaccagagaattcgaatacaatacactannntgcatcaggt

SEQ ID NO: 3578 - DNA, 46 bp, Artificial Sequence
  Synthesized adaptor olignonucleotide
  misc_feature (34)..(36): n is a, c, g, or t
tgcaggaccagagaattcgaatacaccacgcctnnntgcatcaggt

SEQ ID NO: 3579 - DNA, 46 bp, Artificial Sequence
  Synthesized adaptor olignonucleotide
  misc_feature (34)..(36): n is a, c, g, or t
tgcaggaccagagaattcgaatacatgaagtggnnntgcatcaggt

SEQ ID NO: 3580 - DNA, 46 bp, Artificial Sequence
  Synthesized adaptor olignonucleotide
  misc_feature (34)..(36): n is a, c, g, or t
tgcaggaccagagaattcgaatacagagttgtcnnntgcatcaggt

SEQ ID NO: 3581 - DNA, 46 bp, Artificial Sequence
  Synthesized adaptor olignonucleotide
  misc_feature (34)..(36): n is a, c, g, or t
tgcaggaccagagaattcgaatacacccggcttnnntgcatcaggt

SEQ ID NO: 3582 - DNA, 46 bp, Artificial Sequence
  Synthesized adaptor olignonucleotide
  misc_feature (34)..(36): n is a, c, g, or t
tgcaggaccagagaattcgaatacacagataggnnntgcatcaggt

SEQ ID NO: 3583 - DNA, 46 bp, Artificial Sequence
  Synthesized adaptor olignonucleotide
  misc_feature (34)..(36): n is a, c, g, or t
tgcaggaccagagaattcgaatacaaagtccgtnnntgcatcaggt

SEQ ID NO: 3584 - DNA, 46 bp, Artificial Sequence
  Synthesized adaptor olignonucleotide
  misc_feature (34)..(36): n is a, c, g, or t
tgcaggaccagagaattcgaatacaaatcagaannntgcatcaggt

SEQ ID NO: 3585 - DNA, 46 bp, Artificial Sequence
  Synthesized adaptor olignonucleotide
  misc_feature (34)..(36): n is a, c, g, or t
tgcaggaccagagaattcgaatacacactcagannntgcatcaggt

SEQ ID NO: 3586 - DNA, 46 bp, Artificial Sequence
  Synthesized adaptor olignonucleotide
  misc_feature (34)..(36): n is a, c, g, or t
tgcaggaccagagaattcgaatacattattccannntgcatcaggt

SEQ ID NO: 3587 - DNA, 46 bp, Artificial Sequence
  Synthesized adaptor olignonucleotide
  misc_feature (34)..(36): n is a, c, g, or t
tgcaggaccagagaattcgaatacaaagtaacannntgcatcaggt

SEQ ID NO: 3588 - DNA, 46 bp, Artificial Sequence
  Synthesized adaptor olignonucleotide
  misc_feature (34)..(36): n is a, c, g, or t
tgcaggaccagagaattcgaatacattgtgcctnnntgcatcaggt

SEQ ID NO: 3589 - DNA, 46 bp, Artificial Sequence
  Synthesized adaptor olignonucleotide
  misc_feature (34)..(36): n is a, c, g, or t
tgcaggaccagagaattcgaatacaaagagtcgnnntgcatcaggt

SEQ ID NO: 3590 - DNA, 46 bp, Artificial Sequence
  Synthesized adaptor olignonucleotide
  misc_feature (34)..(36): n is a, c, g, or t
tgcaggaccagagaattcgaatacaagctgttgnnntgcatcaggt

SEQ ID NO: 3591 - DNA, 46 bp, Artificial Sequence
  Synthesized adaptor olignonucleotide
  misc_feature (34)..(36): n is a, c, g, or t
tgcaggaccagagaattcgaatacaatattgacnnntgcatcaggt

SEQ ID NO: 3592 - DNA, 46 bp, Artificial Sequence
  Synthesized adaptor olignonucleotide
  misc_feature (34)..(36): n is a, c, g, or t
tgcaggaccagagaattcgaatacaaaatatttnnntgcatcaggt

SEQ ID NO: 3593 - DNA, 46 bp, Artificial Sequence
  Synthesized adaptor olignonucleotide
  misc_feature (34)..(36): n is a, c, g, or t
tgcaggaccagagaattcgaatacactcaagacnnntgcatcaggt

SEQ ID NO: 3594 - DNA, 46 bp, Artificial Sequence
  Synthesized adaptor olignonucleotide
  misc_feature (34)..(36): n is a, c, g, or t
tgcaggaccagagaattcgaatacaagacgaacnnntgcatcaggt

SEQ ID NO: 3595 - DNA, 46 bp, Artificial Sequence
  Synthesized adaptor olignonucleotide
  misc_feature (34)..(36): n is a, c, g, or t
tgcaggaccagagaattcgaatacaaggcaggcnnntgcatcaggt

SEQ ID NO: 3596 - DNA, 46 bp, Artificial Sequence
  Synthesized adaptor olignonucleotide
  misc_feature (34)..(36): n is a, c, g, or t
tgcaggaccagagaattcgaatacaacttatagnnntgcatcaggt

SEQ ID NO: 3597 - DNA, 46 bp, Artificial Sequence
  Synthesized adaptor olignonucleotide
  misc_feature (34)..(36): n is a, c, g, or t
tgcaggaccagagaattcgaatacactactaaannntgcatcaggt

SEQ ID NO: 3598 - DNA, 46 bp, Artificial Sequence
  Synthesized adaptor olignonucleotide
  misc_feature (34)..(36): n is a, c, g, or t
tgcaggaccagagaattcgaatacatttagagtnnntgcatcaggt

SEQ ID NO: 3599 - DNA, 46 bp, Artificial Sequence
  Synthesized adaptor olignonucleotide
  misc_feature (34)..(36): n is a, c, g, or t
tgcaggaccagagaattcgaatacactgcttcannntgcatcaggt

SEQ ID NO: 3600 - DNA, 46 bp, Artificial Sequence
  Synthesized adaptor olignonucleotide
  misc_feature (34)..(36): n is a, c, g, or t
tgcaggaccagagaattcgaatacaaggttctgnnntgcatcaggt

SEQ ID NO: 3601 - DNA, 46 bp, Artificial Sequence
  Synthesized adaptor olignonucleotide
  misc_feature (34)..(36): n is a, c, g, or t
tgcaggaccagagaattcgaatacaagtaggtgnnntgcatcaggt

SEQ ID NO: 3602 - DNA, 46 bp, Artificial Sequence
  Synthesized adaptor olignonucleotide
  misc_feature (34)..(36): n is a, c, g, or t
tgcaggaccagagaattcgaatacacccgataannntgcatcaggt

SEQ ID NO: 3603 - DNA, 46 bp, Artificial Sequence
  Synthesized adaptor olignonucleotide
  misc_feature (34)..(36): n is a, c, g, or t
tgcaggaccagagaattcgaatacacagagtgannntgcatcaggt

SEQ ID NO: 3604 - DNA, 46 bp, Artificial Sequence
  Synthesized adaptor olignonucleotide
  misc_feature (34)..(36): n is a, c, g, or t
tgcaggaccagagaattcgaatacagttcgcttnnntgcatcaggt

SEQ ID NO: 3605 - DNA, 46 bp, Artificial Sequence
  Synthesized adaptor olignonucleotide
  misc_feature (34)..(36): n is a, c, g, or t
tgcaggaccagagaattcgaatacagttatcaannntgcatcaggt

SEQ ID NO: 3606 - DNA, 46 bp, Artificial Sequence
  Synthesized adaptor olignonucleotide
  misc_feature (34)..(36): n is a, c, g, or t
tgcaggaccagagaattcgaatacaagatgctcnnntgcatcaggt

SEQ ID NO: 3607 - DNA, 46 bp, Artificial Sequence
  Synthesized adaptor olignonucleotide
  misc_feature (34)..(36): n is a, c, g, or t
tgcaggaccagagaattcgaatacaaacgtaaannntgcatcaggt

SEQ ID NO: 3608 - DNA, 46 bp, Artificial Sequence
  Synthesized adaptor olignonucleotide
  misc_feature (34)..(36): n is a, c, g, or t
tgcaggaccagagaattcgaatacagcatttccnnntgcatcaggt

SEQ ID NO: 3609 - DNA, 46 bp, Artificial Sequence
  Synthesized adaptor oligonucleotide
  misc_feature (34)..(36): n is a, c, g, or t
tgcaggaccagagaattcgaatacatgattcaannnacgtatgcca

SEQ ID NO: 3610 - DNA, 46 bp, Artificial Sequence
  Synthesized adaptor oligonucleotide
  misc_feature (34)..(36): n is a, c, g, or t
tgcaggaccagagaattcgaatacaacaagtaannnacgtatgcca

SEQ ID NO: 3611 - DNA, 46 bp, Artificial Sequence
  Synthesized adaptor oligonucleotide
  misc_feature (34)..(36): n is a, c, g, or t
tgcaggaccagagaattcgaatacaatgaccgtnnnacgtatgcca

SEQ ID NO: 3612 - DNA, 46 bp, Artificial Sequence
  Synthesized adaptor oligonucleotide
  misc_feature (34)..(36): n is a, c, g, or t
tgcaggaccagagaattcgaatacaatctcgtcnnnacgtatgcca

SEQ ID NO: 3613 - DNA, 46 bp, Artificial Sequence
  Synthesized adaptor oligonucleotide
  misc_feature (34)..(36): n is a, c, g, or t
tgcaggaccagagaattcgaatacaggcaacaannnacgtatgcca

SEQ ID NO: 3614 - DNA, 46 bp, Artificial Sequence
  Synthesized adaptor oligonucleotide
  misc_feature (34)..(36): n is a, c, g, or t
tgcaggaccagagaattcgaatacaaggcgcctnnnacgtatgcca

SEQ ID NO: 3615 - DNA, 46 bp, Artificial Sequence
  Synthesized adaptor oligonucleotide
  misc_feature (34)..(36): n is a, c, g, or t
tgcaggaccagagaattcgaatacatgcttaccnnnacgtatgcca

SEQ ID NO: 3616 - DNA, 46 bp, Artificial Sequence
  Synthesized adaptor oligonucleotide
  misc_feature (34)..(36): n is a, c, g, or t
tgcaggaccagagaattcgaatacacgcacgacnnnacgtatgcca

SEQ ID NO: 3617 - DNA, 46 bp, Artificial Sequence
  Synthesized adaptor oligonucleotide
  misc_feature (34)..(36): n is a, c, g, or t
tgcaggaccagagaattcgaatacagaggctttnnnacgtatgcca

SEQ ID NO: 3618 - DNA, 46 bp, Artificial Sequence
  Synthesized adaptor oligonucleotide
  misc_feature (34)..(36): n is a, c, g, or t
tgcaggaccagagaattcgaatacacattcattnnnacgtatgcca

SEQ ID NO: 3619 - DNA, 46 bp, Artificial Sequence
  Synthesized adaptor oligonucleotide
  misc_feature (34)..(36): n is a, c, g, or t
tgcaggaccagagaattcgaatacacaatcatannnacgtatgcca

SEQ ID NO: 3620 - DNA, 46 bp, Artificial Sequence
  Synthesized adaptor oligonucleotide
  misc_feature (34)..(36): n is a, c, g, or t
tgcaggaccagagaattcgaatacactacgatgnnnacgtatgcca

SEQ ID NO: 3621 - DNA, 46 bp, Artificial Sequence
  Synthesized adaptor oligonucleotide
  misc_feature (34)..(36): n is a, c, g, or t
tgcaggaccagagaattcgaatacagaggtacannnacgtatgcca

SEQ ID NO: 3622 - DNA, 46 bp, Artificial Sequence
  Synthesized adaptor oligonucleotide
  misc_feature (34)..(36): n is a, c, g, or t
tgcaggaccagagaattcgaatacactcgtctannnacgtatgcca

SEQ ID NO: 3623 - DNA, 46 bp, Artificial Sequence
  Synthesized adaptor oligonucleotide
  misc_feature (34)..(36): n is a, c, g, or t
tgcaggaccagagaattcgaatacaagaaggagnnnacgtatgcca

SEQ ID NO: 3624 - DNA, 46 bp, Artificial Sequence
  Synthesized adaptor oligonucleotide
  misc_feature (34)..(36): n is a, c, g, or t
tgcaggaccagagaattcgaatacagtgacatcnnnacgtatgcca

SEQ ID NO: 3625 - DNA, 46 bp, Artificial Sequence
  Synthesized adaptor oligonucleotide
  misc_feature (34)..(36): n is a, c, g, or t
tgcaggaccagagaattcgaatacagcggtggannnacgtatgcca

SEQ ID NO: 3626 - DNA, 46 bp, Artificial Sequence
  Synthesized adaptor oligonucleotide
  misc_feature (34)..(36): n is a, c, g, or t
tgcaggaccagagaattcgaatacacacaaattnnnacgtatgcca

SEQ ID NO: 3627 - DNA, 46 bp, Artificial Sequence
  Synthesized adaptor oligonucleotide
  misc_feature (34)..(36): n is a, c, g, or t
tgcaggaccagagaattcgaatacaccgtgcagnnnacgtatgcca

SEQ ID NO: 3628 - DNA, 46 bp, Artificial Sequence
  Synthesized adaptor oligonucleotide
  misc_feature (34)..(36): n is a, c, g, or t
tgcaggaccagagaattcgaatacaaaattaccnnnacgtatgcca

SEQ ID NO: 3629 - DNA, 46 bp, Artificial Sequence
  Synthesized adaptor oligonucleotide
  misc_feature (34)..(36): n is a, c, g, or t
tgcaggaccagagaattcgaatacagcagacaannnacgtatgcca

SEQ ID NO: 3630 - DNA, 46 bp, Artificial Sequence
  Synthesized adaptor oligonucleotide
  misc_feature (34)..(36): n is a, c, g, or t
tgcaggaccagagaattcgaatacattctaagannnacgtatgcca

SEQ ID NO: 3631 - DNA, 46 bp, Artificial Sequence
  Synthesized adaptor oligonucleotide
  misc_feature (34)..(36): n is a, c, g, or t
tgcaggaccagagaattcgaatacacattgagcnnnacgtatgcca

SEQ ID NO: 3632 - DNA, 46 bp, Artificial Sequence
  Synthesized adaptor oligonucleotide
  misc_feature (34)..(36): n is a, c, g, or t
tgcaggaccagagaattcgaatacaatgagagcnnnacgtatgcca

SEQ ID NO: 3633 - DNA, 46 bp, Artificial Sequence
  Synthesized adaptor oligonucleotide
  misc_feature (34)..(36): n is a, c, g, or t
tgcaggaccagagaattcgaatacatttcccgannnacgtatgcca

SEQ ID NO: 3634 - DNA, 46 bp, Artificial Sequence
  Synthesized adaptor oligonucleotide
  misc_feature (34)..(36): n is a, c, g, or t
tgcaggaccagagaattcgaatacattgcgaacnnnacgtatgcca

SEQ ID NO: 3635 - DNA, 46 bp, Artificial Sequence
  Synthesized adaptor oligonucleotide
  misc_feature (34)..(36): n is a, c, g, or t
tgcaggaccagagaattcgaatacatggagatgnnnacgtatgcca

SEQ ID NO: 3636 - DNA, 46 bp, Artificial Sequence
  Synthesized adaptor oligonucleotide
  misc_feature (34)..(36): n is a, c, g, or t
tgcaggaccagagaattcgaatacaccaaccccnnnacgtatgcca

SEQ ID NO: 3637 - DNA, 46 bp, Artificial Sequence
  Synthesized adaptor oligonucleotide
  misc_feature (34)..(36): n is a, c, g, or t
tgcaggaccagagaattcgaatacagacaatggnnnacgtatgcca

SEQ ID NO: 3638 - DNA, 46 bp, Artificial Sequence
  Synthesized adaptor oligonucleotide
  misc_feature (34)..(36): n is a, c, g, or t
tgcaggaccagagaattcgaatacacagagcccnnnacgtatgcca

SEQ ID NO: 3639 - DNA, 46 bp, Artificial Sequence
  Synthesized adaptor oligonucleotide
  misc_feature (34)..(36): n is a, c, g, or t
tgcaggaccagagaattcgaatacaaagaatacnnnacgtatgcca

SEQ ID NO: 3640 - DNA, 46 bp, Artificial Sequence
  Synthesized adaptor oligonucleotide
  misc_feature (34)..(36): n is a, c, g, or t
tgcaggaccagagaattcgaatacaaggtaaatnnnacgtatgcca

SEQ ID NO: 3641 - DNA, 46 bp, Artificial Sequence
  Synthesized adaptor oligonucleotide
  misc_feature (34)..(36): n is a, c, g, or t
tgcaggaccagagaattcgaatacagccccaagnnnacgtatgcca

SEQ ID NO: 3642 - DNA, 46 bp, Artificial Sequence
  Synthesized adaptor oligonucleotide
  misc_feature (34)..(36): n is a, c, g, or t
tgcaggaccagagaattcgaatacactgcttgtnnnacgtatgcca

SEQ ID NO: 3643 - DNA, 46 bp, Artificial Sequence
  Synthesized adaptor oligonucleotide
  misc_feature (34)..(36): n is a, c, g, or t
tgcaggaccagagaattcgaatacaacacggccnnnacgtatgcca

SEQ ID NO: 3644 - DNA, 46 bp, Artificial Sequence
  Synthesized adaptor oligonucleotide
  misc_feature (34)..(36): n is a, c, g, or t
tgcaggaccagagaattcgaatacaacgacctannnacgtatgcca

SEQ ID NO: 3645 - DNA, 46 bp, Artificial Sequence
  Synthesized adaptor oligonucleotide
  misc_feature (34)..(36): n is a, c, g, or t
tgcaggaccagagaattcgaatacaattagaagnnnacgtatgcca

SEQ ID NO: 3646 - DNA, 46 bp, Artificial Sequence
  Synthesized adaptor oligonucleotide
  misc_feature (34)..(36): n is a, c, g, or t
tgcaggaccagagaattcgaatacagccgtacgnnnacgtatgcca

SEQ ID NO: 3647 - DNA, 46 bp, Artificial Sequence
  Synthesized adaptor oligonucleotide
  misc_feature (34)..(36): n is a, c, g, or t
tgcaggaccagagaattcgaatacacagaaagcnnnacgtatgcca

SEQ ID NO: 3648 - DNA, 46 bp, Artificial Sequence
  Synthesized adaptor oligonucleotide
  misc_feature (34)..(36): n is a, c, g, or t
tgcaggaccagagaattcgaatacaccaccttannnacgtatgcca

SEQ ID NO: 3649 - DNA, 46 bp, Artificial Sequence
  Synthesized adaptor oligonucleotide
  misc_feature (34)..(36): n is a, c, g, or t
tgcaggaccagagaattcgaatacaaaggattannnacgtatgcca

SEQ ID NO: 3650 - DNA, 46 bp, Artificial Sequence
  Synthesized adaptor oligonucleotide
  misc_feature (34)..(36): n is a, c, g, or t
tgcaggaccagagaattcgaatacaagcaaatannnacgtatgcca

SEQ ID NO: 3651 - DNA, 46 bp, Artificial Sequence
  Synthesized adaptor oligonucleotide
  misc_feature (34)..(36): n is a, c, g, or t
tgcaggaccagagaattcgaatacacacttcgtnnnacgtatgcca

SEQ ID NO: 3652 - DNA, 46 bp, Artificial Sequence
  Synthesized adaptor oligonucleotide
  misc_feature (34)..(36): n is a, c, g, or t
tgcaggaccagagaattcgaatacaattcgtccnnnacgtatgcca

SEQ ID NO: 3653 - DNA, 46 bp, Artificial Sequence
  Synthesized adaptor oligonucleotide
  misc_feature (34)..(36): n is a, c, g, or t
tgcaggaccagagaattcgaatacattcttggcnnnacgtatgcca

SEQ ID NO: 3654 - DNA, 46 bp, Artificial Sequence
  Synthesized adaptor oligonucleotide
  misc_feature (34)..(36): n is a, c, g, or t
tgcaggaccagagaattcgaatacattggctctnnnacgtatgcca

SEQ ID NO: 3655 - DNA, 46 bp, Artificial Sequence
  Synthesized adaptor oligonucleotide
  misc_feature (34)..(36): n is a, c, g, or t
tgcaggaccagagaattcgaatacaggagactannnacgtatgcca

SEQ ID NO: 3656 - DNA, 46 bp, Artificial Sequence
  Synthesized adaptor oligonucleotide
  misc_feature (34)..(36): n is a, c, g, or t
tgcaggaccagagaattcgaatacaaatacttgnnnacgtatgcca

SEQ ID NO: 3657 - DNA, 46 bp, Artificial Sequence
  Synthesized adaptor oligonucleotide
  misc_feature (34)..(36): n is a, c, g, or t
tgcaggaccagagaattcgaatacagctgttagnnnacgtatgcca

SEQ ID NO: 3658 - DNA, 46 bp, Artificial Sequence
  Synthesized adaptor oligonucleotide
  misc_feature (34)..(36): n is a, c, g, or t
tgcaggaccagagaattcgaatacaacaacctgnnnacgtatgcca

SEQ ID NO: 3659 - DNA, 46 bp, Artificial Sequence
  Synthesized adaptor oligonucleotide
  misc_feature (34)..(36): n is a, c, g, or t
tgcaggaccagagaattcgaatacatcgtgcccnnnacgtatgcca

SEQ ID NO: 3660 - DNA, 46 bp, Artificial Sequence
  Synthesized adaptor oligonucleotide
  misc_feature (34)..(36): n is a, c, g, or t
tgcaggaccagagaattcgaatacagactctctnnnacgtatgcca

SEQ ID NO: 3661 - DNA, 46 bp, Artificial Sequence
  Synthesized adaptor oligonucleotide
  misc_feature (34)..(36): n is a, c, g, or t
tgcaggaccagagaattcgaatacatataacacnnnacgtatgcca

SEQ ID NO: 3662 - DNA, 46 bp, Artificial Sequence
  Synthesized adaptor oligonucleotide
  misc_feature (34)..(36): n is a, c, g, or t
tgcaggaccagagaattcgaatacatgagcctannnacgtatgcca

SEQ ID NO: 3663 - DNA, 46 bp, Artificial Sequence
  Synthesized adaptor oligonucleotide
  misc_feature (34)..(36): n is a, c, g, or t
tgcaggaccagagaattcgaatacacagacgaannnacgtatgcca

SEQ ID NO: 3664 - DNA, 46 bp, Artificial Sequence
  Synthesized adaptor oligonucleotide
  misc_feature (34)..(36): n is a, c, g, or t
tgcaggaccagagaattcgaatacacggaatgannnacgtatgcca

SEQ ID NO: 3665 - DNA, 46 bp, Artificial Sequence
  Synthesized adaptor oligonucleotide
  misc_feature (34)..(36): n is a, c, g, or t
tgcaggaccagagaattcgaatacaggtgatgannnacgtatgcca

SEQ ID NO: 3666 - DNA, 46 bp, Artificial Sequence
  Synthesized adaptor oligonucleotide
  misc_feature (34)..(36): n is a, c, g, or t
tgcaggaccagagaattcgaatacacacctctannnacgtatgcca

SEQ ID NO: 3667 - DNA, 46 bp, Artificial Sequence
  Synthesized adaptor oligonucleotide
  misc_feature (34)..(36): n is a, c, g, or t
tgcaggaccagagaattcgaatacaactggtacnnnacgtatgcca

SEQ ID NO: 3668 - DNA, 46 bp, Artificial Sequence
  Synthesized adaptor oligonucleotide
  misc_feature (34)..(36): n is a, c, g, or t
tgcaggaccagagaattcgaatacagcaaatccnnnacgtatgcca

SEQ ID NO: 3669 - DNA, 46 bp, Artificial Sequence
  Synthesized adaptor oligonucleotide
  misc_feature (34)..(36): n is a, c, g, or t
tgcaggaccagagaattcgaatacaaatataaannnctagcgttac

SEQ ID NO: 3670 - DNA, 46 bp, Artificial Sequence
  Synthesized adaptor oligonucleotide
  misc_feature (34)..(36): n is a, c, g, or t
tgcaggaccagagaattcgaatacatggttatannnctagcgttac

SEQ ID NO: 3671 - DNA, 46 bp, Artificial Sequence
  Synthesized adaptor oligonucleotide
  misc_feature (34)..(36): n is a, c, g, or t
tgcaggaccagagaattcgaatacaacccgctcnnnctagcgttac

SEQ ID NO: 3672 - DNA, 46 bp, Artificial Sequence
  Synthesized adaptor oligonucleotide
  misc_feature (34)..(36): n is a, c, g, or t
tgcaggaccagagaattcgaatacatgcgaaagnnnctagcgttac

SEQ ID NO: 3673 - DNA, 46 bp, Artificial Sequence
  Synthesized adaptor oligonucleotide
  misc_feature (34)..(36): n is a, c, g, or t
tgcaggaccagagaattcgaatacacgtctgccnnnctagcgttac

SEQ ID NO: 3674 - DNA, 46 bp, Artificial Sequence
  Synthesized adaptor oligonucleotide
  misc_feature (34)..(36): n is a, c, g, or t
tgcaggaccagagaattcgaatacaagttgtatnnnctagcgttac

SEQ ID NO: 3675 - DNA, 46 bp, Artificial Sequence
  Synthesized adaptor oligonucleotide
  misc_feature (34)..(36): n is a, c, g, or t
tgcaggaccagagaattcgaatacaggctactannnctagcgttac

SEQ ID NO: 3676 - DNA, 46 bp, Artificial Sequence
  Synthesized adaptor oligonucleotide
  misc_feature (34)..(36): n is a, c, g, or t
tgcaggaccagagaattcgaatacaacatcatannnctagcgttac

SEQ ID NO: 3677 - DNA, 46 bp, Artificial Sequence
  Synthesized adaptor oligonucleotide
  misc_feature (34)..(36): n is a, c, g, or t
tgcaggaccagagaattcgaatacaattccaggnnnctagcgttac

SEQ ID NO: 3678 - DNA, 46 bp, Artificial Sequence
  Synthesized adaptor oligonucleotide
  misc_feature (34)..(36): n is a, c, g, or t
tgcaggaccagagaattcgaatacattttgttgnnnctagcgttac

SEQ ID NO: 3679 - DNA, 46 bp, Artificial Sequence
  Synthesized adaptor oligonucleotide
  misc_feature (34)..(36): n is a, c, g, or t
tgcaggaccagagaattcgaatacaagtggacannnctagcgttac

SEQ ID NO: 3680 - DNA, 46 bp, Artificial Sequence
  Synthesized adaptor oligonucleotide
  misc_feature (34)..(36): n is a, c, g, or t
tgcaggaccagagaattcgaatacagagaggttnnnctagcgttac

SEQ ID NO: 3681 - DNA, 46 bp, Artificial Sequence
  Synthesized adaptor oligonucleotide
  misc_feature (34)..(36): n is a, c, g, or t
tgcaggaccagagaattcgaatacacttcccggnnnctagcgttac

SEQ ID NO: 3682 - DNA, 46 bp, Artificial Sequence
  Synthesized adaptor oligonucleotide
  misc_feature (34)..(36): n is a, c, g, or t
tgcaggaccagagaattcgaatacaacctccatnnnctagcgttac

SEQ ID NO: 3683 - DNA, 46 bp, Artificial Sequence
  Synthesized adaptor oligonucleotide
  misc_feature (34)..(36): n is a, c, g, or t
tgcaggaccagagaattcgaatacacaagaggtnnnctagcgttac

SEQ ID NO: 3684 - DNA, 46 bp, Artificial Sequence
  Synthesized adaptor oligonucleotide
  misc_feature (34)..(36): n is a, c, g, or t
tgcaggaccagagaattcgaatacagaaagtcgnnnctagcgttac

SEQ ID NO: 3685 - DNA, 46 bp, Artificial Sequence
  Synthesized adaptor oligonucleotide
  misc_feature (34)..(36): n is a, c, g, or t
tgcaggaccagagaattcgaatacacgcgaaaannnctagcgttac

SEQ ID NO: 3686 - DNA, 46 bp, Artificial Sequence
  Synthesized adaptor oligonucleotide
  misc_feature (34)..(36): n is a, c, g, or t
tgcaggaccagagaattcgaatacacctggcagnnnctagcgttac

SEQ ID NO: 3687 - DNA, 46 bp, Artificial Sequence
  Synthesized adaptor oligonucleotide
  misc_feature (34)..(36): n is a, c, g, or t
tgcaggaccagagaattcgaatacaagcagatgnnnctagcgttac

SEQ ID NO: 3688 - DNA, 46 bp, Artificial Sequence
  Synthesized adaptor oligonucleotide
  misc_feature (34)..(36): n is a, c, g, or t
tgcaggaccagagaattcgaatacaagaggccgnnnctagcgttac

SEQ ID NO: 3689 - DNA, 46 bp, Artificial Sequence
  Synthesized adaptor oligonucleotide
  misc_feature (34)..(36): n is a, c, g, or t
tgcaggaccagagaattcgaatacacgtgcgtgnnnctagcgttac

SEQ ID NO: 3690 - DNA, 46 bp, Artificial Sequence
  Synthesized adaptor oligonucleotide
  misc_feature (34)..(36): n is a, c, g, or t
tgcaggaccagagaattcgaatacatggtaggannnctagcgttac

SEQ ID NO: 3691 - DNA, 46 bp, Artificial Sequence
  Synthesized adaptor oligonucleotide
  misc_feature (34)..(36): n is a, c, g, or t
tgcaggaccagagaattcgaatacacgcgccaannnctagcgttac

SEQ ID NO: 3692 - DNA, 46 bp, Artificial Sequence
  Synthesized adaptor oligonucleotide
  misc_feature (34)..(36): n is a, c, g, or t
tgcaggaccagagaattcgaatacatgagcactnnnctagcgttac

SEQ ID NO: 3693 - DNA, 46 bp, Artificial Sequence
  Synthesized adaptor oligonucleotide
  misc_feature (34)..(36): n is a, c, g, or t
tgcaggaccagagaattcgaatacatcatcgtcnnnctagcgttac

SEQ ID NO: 3694 - DNA, 46 bp, Artificial Sequence
  Synthesized adaptor oligonucleotide
  misc_feature (34)..(36): n is a, c, g, or t
tgcaggaccagagaattcgaatacaagccaagannnctagcgttac

SEQ ID NO: 3695 - DNA, 46 bp, Artificial Sequence
  Synthesized adaptor oligonucleotide
  misc_feature (34)..(36): n is a, c, g, or t
tgcaggaccagagaattcgaatacacgaggacgnnnctagcgttac

SEQ ID NO: 3696 - DNA, 46 bp, Artificial Sequence
  Synthesized adaptor oligonucleotide
  misc_feature (34)..(36): n is a, c, g, or t
tgcaggaccagagaattcgaatacatgtgactgnnnctagcgttac

SEQ ID NO: 3697 - DNA, 46 bp, Artificial Sequence
  Synthesized adaptor oligonucleotide
  misc_feature (34)..(36): n is a, c, g, or t
tgcaggaccagagaattcgaatacaaccttgagnnnctagcgttac

SEQ ID NO: 3698 - DNA, 46 bp, Artificial Sequence
  Synthesized adaptor oligonucleotide
  misc_feature (34)..(36): n is a, c, g, or t
tgcaggaccagagaattcgaatacagttaagttnnnctagcgttac

SEQ ID NO: 3699 - DNA, 46 bp, Artificial Sequence
  Synthesized adaptor oligonucleotide
  misc_feature (34)..(36): n is a, c, g, or t
tgcaggaccagagaattcgaatacaacccaggcnnnctagcgttac

SEQ ID NO: 3700 - DNA, 46 bp, Artificial Sequence
  Synthesized adaptor oligonucleotide
  misc_feature (34)..(36): n is a, c, g, or t
tgcaggaccagagaattcgaatacaccgatgatnnnctagcgttac

SEQ ID NO: 3701 - DNA, 46 bp, Artificial Sequence
  Synthesized adaptor oligonucleotide
  misc_feature (34)..(36): n is a, c, g, or t
tgcaggaccagagaattcgaatacagatctcgannnctagcgttac

SEQ ID NO: 3702 - DNA, 46 bp, Artificial Sequence
  Synthesized adaptor oligonucleotide
  misc_feature (34)..(36): n is a, c, g, or t
tgcaggaccagagaattcgaatacaggagatgtnnnctagcgttac

SEQ ID NO: 3703 - DNA, 46 bp, Artificial Sequence
  Synthesized adaptor oligonucleotide
  misc_feature (34)..(36): n is a, c, g, or t
tgcaggaccagagaattcgaatacataggtaaannnctagcgttac

SEQ ID NO: 3704 - DNA, 46 bp, Artificial Sequence
  Synthesized adaptor oligonucleotide
  misc_feature (34)..(36): n is a, c, g, or t
tgcaggaccagagaattcgaatacaactcagcannnctagcgttac

SEQ ID NO: 3705 - DNA, 46 bp, Artificial Sequence
  Synthesized adaptor oligonucleotide
  misc_feature (34)..(36): n is a, c, g, or t
tgcaggaccagagaattcgaatacaagataggcnnnctagcgttac

SEQ ID NO: 3706 - DNA, 46 bp, Artificial Sequence
  Synthesized adaptor oligonucleotide
  misc_feature (34)..(36): n is a, c, g, or t
tgcaggaccagagaattcgaatacacgaattgcnnnctagcgttac

SEQ ID NO: 3707 - DNA, 46 bp, Artificial Sequence
  Synthesized adaptor oligonucleotide
  misc_feature (34)..(36): n is a, c, g, or t
tgcaggaccagagaattcgaatacataccaggtnnnctagcgttac

SEQ ID NO: 3708 - DNA, 46 bp, Artificial Sequence
  Synthesized adaptor oligonucleotide
  misc_feature (34)..(36): n is a, c, g, or t
tgcaggaccagagaattcgaatacatatactctnnnctagcgttac

SEQ ID NO: 3709 - DNA, 46 bp, Artificial Sequence
  Synthesized adaptor oligonucleotide
  misc_feature (34)..(36): n is a, c, g, or t
tgcaggaccagagaattcgaatacaagcttctcnnnctagcgttac

SEQ ID NO: 3710 - DNA, 46 bp, Artificial Sequence
  Synthesized adaptor oligonucleotide
  misc_feature (34)..(36): n is a, c, g, or t
tgcaggaccagagaattcgaatacaacctgagtnnnctagcgttac

SEQ ID NO: 3711 - DNA, 46 bp, Artificial Sequence
  Synthesized adaptor oligonucleotide
  misc_feature (34)..(36): n is a, c, g, or t
tgcaggaccagagaattcgaatacacatagattnnnctagcgttac

SEQ ID NO: 3712 - DNA, 46 bp, Artificial Sequence
  Synthesized adaptor oligonucleotide
  misc_feature (34)..(36): n is a, c, g, or t
tgcaggaccagagaattcgaatacaagcggaatnnnctagcgttac

SEQ ID NO: 3713 - DNA, 46 bp, Artificial Sequence
  Synthesized adaptor oligonucleotide
  misc_feature (34)..(36): n is a, c, g, or t
tgcaggaccagagaattcgaatacaggcatgccnnnctagcgttac

SEQ ID NO: 3714 - DNA, 46 bp, Artificial Sequence
  Synthesized adaptor oligonucleotide
  misc_feature (34)..(36): n is a, c, g, or t
tgcaggaccagagaattcgaatacagatatccgnnnctagcgttac

SEQ ID NO: 3715 - DNA, 46 bp, Artificial Sequence
  Synthesized adaptor oligonucleotide
  misc_feature (34)..(36): n is a, c, g, or t
tgcaggaccagagaattcgaatacagctcagcgnnnctagcgttac

SEQ ID NO: 3716 - DNA, 46 bp, Artificial Sequence
  Synthesized adaptor oligonucleotide
  misc_feature (34)..(36): n is a, c, g, or t
tgcaggaccagagaattcgaatacacttcaaggnnnctagcgttac

SEQ ID NO: 3717 - DNA, 46 bp, Artificial Sequence
  Synthesized adaptor oligonucleotide
  misc_feature (34)..(36): n is a, c, g, or t
tgcaggaccagagaattcgaatacatcagtaatnnnctagcgttac

SEQ ID NO: 3718 - DNA, 46 bp, Artificial Sequence
  Synthesized adaptor oligonucleotide
  misc_feature (34)..(36): n is a, c, g, or t
tgcaggaccagagaattcgaatacaccggccaannnctagcgttac

SEQ ID NO: 3719 - DNA, 46 bp, Artificial Sequence
  Synthesized adaptor oligonucleotide
  misc_feature (34)..(36): n is a, c, g, or t
tgcaggaccagagaattcgaatacaatgatcatnnnctagcgttac

SEQ ID NO: 3720 - DNA, 46 bp, Artificial Sequence
  Synthesized adaptor oligonucleotide
  misc_feature (34)..(36): n is a, c, g, or t
tgcaggaccagagaattcgaatacaggcgcgttnnnctagcgttac

SEQ ID NO: 3721 - DNA, 46 bp, Artificial Sequence
  Synthesized adaptor oligonucleotide
  misc_feature (34)..(36): n is a, c, g, or t
tgcaggaccagagaattcgaatacaagtccgcgnnnctagcgttac

SEQ ID NO: 3722 - DNA, 46 bp, Artificial Sequence
  Synthesized adaptor oligonucleotide
  misc_feature (34)..(36): n is a, c, g, or t
tgcaggaccagagaattcgaatacacactggtannnctagcgttac

SEQ ID NO: 3723 - DNA, 46 bp, Artificial Sequence
  Synthesized adaptor oligonucleotide
  misc_feature (34)..(36): n is a, c, g, or t
tgcaggaccagagaattcgaatacactaagaccnnnctagcgttac

SEQ ID NO: 3724 - DNA, 46 bp, Artificial Sequence
  Synthesized adaptor oligonucleotide
  misc_feature (34)..(36): n is a, c, g, or t
tgcaggaccagagaattcgaatacaacgctacannnctagcgttac

SEQ ID NO: 3725 - DNA, 46 bp, Artificial Sequence
  Synthesized adaptor oligonucleotide
  misc_feature (34)..(36): n is a, c, g, or t
tgcaggaccagagaattcgaatacaaccaaaaannnctagcgttac

SEQ ID NO: 3726 - DNA, 46 bp, Artificial Sequence
  Synthesized adaptor oligonucleotide
  misc_feature (34)..(36): n is a, c, g, or t
tgcaggaccagagaattcgaatacacgagtgccnnnctagcgttac

SEQ ID NO: 3727 - DNA, 46 bp, Artificial Sequence
  Synthesized adaptor oligonucleotide
  misc_feature (34)..(36): n is a, c, g, or t
tgcaggaccagagaattcgaatacaaaccggaannnctagcgttac

SEQ ID NO: 3728 - DNA, 46 bp, Artificial Sequence
  Synthesized adaptor oligonucleotide
  misc_feature (34)..(36): n is a, c, g, or t
tgcaggaccagagaattcgaatacaaaaagcatnnnctagcgttac

SEQ ID NO: 3729 - DNA, 46 bp, Artificial Sequence
  Synthesized adaptor oligonucleotide
  misc_feature (34)..(36): n is a, c, g, or t
tgcaggaccagagaattcgaatacacccccggcnnngatcgacatg

SEQ ID NO: 3730 - DNA, 46 bp, Artificial Sequence
  Synthesized adaptor oligonucleotide
  misc_feature (34)..(36): n is a, c, g, or t
tgcaggaccagagaattcgaatacattggttggnnngatcgacatg

SEQ ID NO: 3731 - DNA, 46 bp, Artificial Sequence
  Synthesized adaptor oligonucleotide
  misc_feature (34)..(36): n is a, c, g, or t
tgcaggaccagagaattcgaatacatccacgttnnngatcgacatg

SEQ ID NO: 3732 - DNA, 46 bp, Artificial Sequence
  Synthesized adaptor oligonucleotide
  misc_feature (34)..(36): n is a, c, g, or t
tgcaggaccagagaattcgaatacaatgaagtannngatcgacatg

SEQ ID NO: 3733 - DNA, 46 bp, Artificial Sequence
  Synthesized adaptor oligonucleotide
  misc_feature (34)..(36): n is a, c, g, or t
tgcaggaccagagaattcgaatacaacaataagnnngatcgacatg

SEQ ID NO: 3734 - DNA, 46 bp, Artificial Sequence
  Synthesized adaptor oligonucleotide
  misc_feature (34)..(36): n is a, c, g, or t
tgcaggaccagagaattcgaatacacatgttttnnngatcgacatg

SEQ ID NO: 3735 - DNA, 46 bp, Artificial Sequence
  Synthesized adaptor oligonucleotide
  misc_feature (34)..(36): n is a, c, g, or t
tgcaggaccagagaattcgaatacatccggtccnnngatcgacatg

SEQ ID NO: 3736 - DNA, 46 bp, Artificial Sequence
  Synthesized adaptor oligonucleotide
  misc_feature (34)..(36): n is a, c, g, or t
tgcaggaccagagaattcgaatacagttacgtgnnngatcgacatg

SEQ ID NO: 3737 - DNA, 46 bp, Artificial Sequence
  Synthesized adaptor oligonucleotide
  misc_feature (34)..(36): n is a, c, g, or t
tgcaggaccagagaattcgaatacaggtcctggnnngatcgacatg

SEQ ID NO: 3738 - DNA, 46 bp, Artificial Sequence
  Synthesized adaptor oligonucleotide
  misc_feature (34)..(36): n is a, c, g, or t
tgcaggaccagagaattcgaatacactgtacagnnngatcgacatg

SEQ ID NO: 3739 - DNA, 46 bp, Artificial Sequence
  Synthesized adaptor oligonucleotide
  misc_feature (34)..(36): n is a, c, g, or t
tgcaggaccagagaattcgaatacacataagttnnngatcgacatg

SEQ ID NO: 3740 - DNA, 46 bp, Artificial Sequence
  Synthesized adaptor oligonucleotide
  misc_feature (34)..(36): n is a, c, g, or t
tgcaggaccagagaattcgaatacaaaatcctannngatcgacatg

SEQ ID NO: 3741 - DNA, 46 bp, Artificial Sequence
  Synthesized adaptor oligonucleotide
  misc_feature (34)..(36): n is a, c, g, or t
tgcaggaccagagaattcgaatacacatcatggnnngatcgacatg

SEQ ID NO: 3742 - DNA, 46 bp, Artificial Sequence
  Synthesized adaptor oligonucleotide
  misc_feature (34)..(36): n is a, c, g, or t
tgcaggaccagagaattcgaatacattcactgcnnngatcgacatg

SEQ ID NO: 3743 - DNA, 46 bp, Artificial Sequence
  Synthesized adaptor oligonucleotide
  misc_feature (34)..(36): n is a, c, g, or t
tgcaggaccagagaattcgaatacattgccgccnnngatcgacatg

SEQ ID NO: 3744 - DNA, 46 bp, Artificial Sequence
  Synthesized adaptor oligonucleotide
  misc_feature (34)..(36): n is a, c, g, or t
tgcaggaccagagaattcgaatacatgtcctgtnnngatcgacatg

SEQ ID NO: 3745 - DNA, 46 bp, Artificial Sequence
  Synthesized adaptor oligonucleotide
  misc_feature (34)..(36): n is a, c, g, or t
tgcaggaccagagaattcgaatacaggcggtctnnngatcgacatg

SEQ ID NO: 3746 - DNA, 46 bp, Artificial Sequence
  Synthesized adaptor oligonucleotide
  misc_feature (34)..(36): n is a, c, g, or t
tgcaggaccagagaattcgaatacaacccacggnnngatcgacatg

SEQ ID NO: 3747 - DNA, 46 bp, Artificial Sequence
  Synthesized adaptor oligonucleotide
  misc_feature (34)..(36): n is a, c, g, or t
tgcaggaccagagaattcgaatacatcctttaannngatcgacatg

SEQ ID NO: 3748 - DNA, 46 bp, Artificial Sequence
  Synthesized adaptor oligonucleotide
  misc_feature (34)..(36): n is a, c, g, or t
tgcaggaccagagaattcgaatacattacaagtnnngatcgacatg

SEQ ID NO: 3749 - DNA, 46 bp, Artificial Sequence
  Synthesized adaptor oligonucleotide
  misc_feature (34)..(36): n is a, c, g, or t
tgcaggaccagagaattcgaatacatcgaggaannngatcgacatg

SEQ ID NO: 3750 - DNA, 46 bp, Artificial Sequence
  Synthesized adaptor oligonucleotide
  misc_feature (34)..(36): n is a, c, g, or t
tgcaggaccagagaattcgaatacagacactcannngatcgacatg

SEQ ID NO: 3751 - DNA, 46 bp, Artificial Sequence
  Synthesized adaptor oligonucleotide
  misc_feature (34)..(36): n is a, c, g, or t
tgcaggaccagagaattcgaatacaactctaggnnngatcgacatg

SEQ ID NO: 3752 - DNA, 46 bp, Artificial Sequence
  Synthesized adaptor oligonucleotide
  misc_feature (34)..(36): n is a, c, g, or t
tgcaggaccagagaattcgaatacaatcttactnnngatcgacatg

SEQ ID NO: 3753 - DNA, 46 bp, Artificial Sequence
  Synthesized adaptor oligonucleotide
  misc_feature (34)..(36): n is a, c, g, or t
tgcaggaccagagaattcgaatacaaaagagaannngatcgacatg

SEQ ID NO: 3754 - DNA, 46 bp, Artificial Sequence
  Synthesized adaptor oligonucleotide
  misc_feature (34)..(36): n is a, c, g, or t
tgcaggaccagagaattcgaatacaacagcagannngatcgacatg

SEQ ID NO: 3755 - DNA, 46 bp, Artificial Sequence
  Synthesized adaptor oligonucleotide
  misc_feature (34)..(36): n is a, c, g, or t
tgcaggaccagagaattcgaatacatgagtaccnnngatcgacatg

SEQ ID NO: 3756 - DNA, 46 bp, Artificial Sequence
  Synthesized adaptor oligonucleotide
  misc_feature (34)..(36): n is a, c, g, or t
tgcaggaccagagaattcgaatacagactgtcannngatcgacatg

SEQ ID NO: 3757 - DNA, 46 bp, Artificial Sequence
  Synthesized adaptor oligonucleotide
  misc_feature (34)..(36): n is a, c, g, or t
tgcaggaccagagaattcgaatacatcgaggccnnngatcgacatg

SEQ ID NO: 3758 - DNA, 46 bp, Artificial Sequence
  Synthesized adaptor oligonucleotide
  misc_feature (34)..(36): n is a, c, g, or t
tgcaggaccagagaattcgaatacagtccatagnnngatcgacatg

SEQ ID NO: 3759 - DNA, 46 bp, Artificial Sequence
  Synthesized adaptor oligonucleotide
  misc_feature (34)..(36): n is a, c, g, or t
tgcaggaccagagaattcgaatacagactgttgnnngatcgacatg

SEQ ID NO: 3760 - DNA, 46 bp, Artificial Sequence
  Synthesized adaptor oligonucleotide
  misc_feature (34)..(36): n is a, c, g, or t
tgcaggaccagagaattcgaatacaacacactgnnngatcgacatg

SEQ ID NO: 3761 - DNA, 46 bp, Artificial Sequence
  Synthesized adaptor oligonucleotide
  misc_feature (34)..(36): n is a, c, g, or t
tgcaggaccagagaattcgaatacaaggtgacannngatcgacatg

SEQ ID NO: 3762 - DNA, 46 bp, Artificial Sequence
  Synthesized adaptor oligonucleotide
  misc_feature (34)..(36): n is a, c, g, or t
tgcaggaccagagaattcgaatacaaaacaatgnnngatcgacatg

SEQ ID NO: 3763 - DNA, 46 bp, Artificial Sequence
  Synthesized adaptor oligonucleotide
  misc_feature (34)..(36): n is a, c, g, or t
tgcaggaccagagaattcgaatacagatttgtannngatcgacatg

SEQ ID NO: 3764 - DNA, 46 bp, Artificial Sequence
  Synthesized adaptor oligonucleotide
  misc_feature (34)..(36): n is a, c, g, or t
tgcaggaccagagaattcgaatacacccccgatnnngatcgacatg

SEQ ID NO: 3765 - DNA, 46 bp, Artificial Sequence
  Synthesized adaptor oligonucleotide
  misc_feature (34)..(36): n is a, c, g, or t
tgcaggaccagagaattcgaatacaaggagcgcnnngatcgacatg

SEQ ID NO: 3766 - DNA, 46 bp, Artificial Sequence
  Synthesized adaptor oligonucleotide
  misc_feature (34)..(36): n is a, c, g, or t
tgcaggaccagagaattcgaatacaccctggagnnngatcgacatg

SEQ ID NO: 3767 - DNA, 46 bp, Artificial Sequence
  Synthesized adaptor oligonucleotide
  misc_feature (34)..(36): n is a, c, g, or t
tgcaggaccagagaattcgaatacacgcactccnnngatcgacatg

SEQ ID NO: 3768 - DNA, 46 bp, Artificial Sequence
  Synthesized adaptor oligonucleotide
  misc_feature (34)..(36): n is a, c, g, or t
tgcaggaccagagaattcgaatacagaagtcagnnngatcgacatg

SEQ ID NO: 3769 - DNA, 46 bp, Artificial Sequence
  Synthesized adaptor oligonucleotide
  misc_feature (34)..(36): n is a, c, g, or t
tgcaggaccagagaattcgaatacaggcgtcgtnnngatcgacatg

SEQ ID NO: 3770 - DNA, 46 bp, Artificial Sequence
  Synthesized adaptor oligonucleotide
  misc_feature (34)..(36): n is a, c, g, or t
tgcaggaccagagaattcgaatacacattgtccnnngatcgacatg

SEQ ID NO: 3771 - DNA, 46 bp, Artificial Sequence
  Synthesized adaptor oligonucleotide
  misc_feature (34)..(36): n is a, c, g, or t
tgcaggaccagagaattcgaatacatagtaactnnngatcgacatg

SEQ ID NO: 3772 - DNA, 46 bp, Artificial Sequence
  Synthesized adaptor oligonucleotide
  misc_feature (34)..(36): n is a, c, g, or t
tgcaggaccagagaattcgaatacatagatgttnnngatcgacatg

SEQ ID NO: 3773 - DNA, 46 bp, Artificial Sequence
  Synthesized adaptor oligonucleotide
  misc_feature (34)..(36): n is a, c, g, or t
tgcaggaccagagaattcgaatacaaatgagcgnnngatcgacatg

SEQ ID NO: 3774 - DNA, 46 bp, Artificial Sequence
  Synthesized adaptor oligonucleotide
  misc_feature (34)..(36): n is a, c, g, or t
tgcaggaccagagaattcgaatacaacttgcgannngatcgacatg

SEQ ID NO: 3775 - DNA, 46 bp, Artificial Sequence
  Synthesized adaptor oligonucleotide
  misc_feature (34)..(36): n is a, c, g, or t
tgcaggaccagagaattcgaatacaggcgtaccnnngatcgacatg

SEQ ID NO: 3776 - DNA, 46 bp, Artificial Sequence
  Synthesized adaptor oligonucleotide
  misc_feature (34)..(36): n is a, c, g, or t
tgcaggaccagagaattcgaatacaggtcacatnnngatcgacatg

SEQ ID NO: 3777 - DNA, 46 bp, Artificial Sequence
  Synthesized adaptor oligonucleotide
  misc_feature (34)..(36): n is a, c, g, or t
tgcaggaccagagaattcgaatacacacttaaannngatcgacatg

SEQ ID NO: 3778 - DNA, 46 bp, Artificial Sequence
  Synthesized adaptor oligonucleotide
  misc_feature (34)..(36): n is a, c, g, or t
tgcaggaccagagaattcgaatacatttacctannngatcgacatg

SEQ ID NO: 3779 - DNA, 46 bp, Artificial Sequence
  Synthesized adaptor oligonucleotide
  misc_feature (34)..(36): n is a, c, g, or t
tgcaggaccagagaattcgaatacaagtttggcnnngatcgacatg

SEQ ID NO: 3780 - DNA, 46 bp, Artificial Sequence
  Synthesized adaptor oligonucleotide
  misc_feature (34)..(36): n is a, c, g, or t
tgcaggaccagagaattcgaatacagagacatgnnngatcgacatg

SEQ ID NO: 3781 - DNA, 46 bp, Artificial Sequence
  Synthesized adaptor oligonucleotide
  misc_feature (34)..(36): n is a, c, g, or t
tgcaggaccagagaattcgaatacagaggcatannngatcgacatg

SEQ ID NO: 3782 - DNA, 46 bp, Artificial Sequence
  Synthesized adaptor oligonucleotide
  misc_feature (34)..(36): n is a, c, g, or t
tgcaggaccagagaattcgaatacacctgctcgnnngatcgacatg

SEQ ID NO: 3783 - DNA, 46 bp, Artificial Sequence
  Synthesized adaptor oligonucleotide
  misc_feature (34)..(36): n is a, c, g, or t
tgcaggaccagagaattcgaatacattgctaggnnngatcgacatg

SEQ ID NO: 3784 - DNA, 46 bp, Artificial Sequence
  Synthesized adaptor oligonucleotide
  misc_feature (34)..(36): n is a, c, g, or t
tgcaggaccagagaattcgaatacatccccgacnnngatcgacatg

SEQ ID NO: 3785 - DNA, 46 bp, Artificial Sequence
  Synthesized adaptor oligonucleotide
  misc_feature (34)..(36): n is a, c, g, or t
tgcaggaccagagaattcgaatacacacgaatcnnngatcgacatg

SEQ ID NO: 3786 - DNA, 46 bp, Artificial Sequence
  Synthesized adaptor oligonucleotide
  misc_feature (34)..(36): n is a, c, g, or t
tgcaggaccagagaattcgaatacagcgtcgcannngatcgacatg

SEQ ID NO: 3787 - DNA, 46 bp, Artificial Sequence
  Synthesized adaptor oligonucleotide
  misc_feature (34)..(36): n is a, c, g, or t
tgcaggaccagagaattcgaatacaaatccaatnnngatcgacatg

SEQ ID NO: 3788 - DNA, 46 bp, Artificial Sequence
  Synthesized adaptor oligonucleotide
  misc_feature (34)..(36): n is a, c, g, or t
tgcaggaccagagaattcgaatacacgcgaaccnnngatcgacatg

SEQ ID NO: 3789 - DNA, 46 bp, Artificial Sequence
  Synthesized adaptor oligonucleotide
  misc_feature (34)..(36): n is a, c, g, or t
tgcaggaccagagaattcgaatacatatgatcannntgcatcaggt

SEQ ID NO: 3790 - DNA, 46 bp, Artificial Sequence
  Synthesized adaptor oligonucleotide
  misc_feature (34)..(36): n is a, c, g, or t
tgcaggaccagagaattcgaatacattggcacannntgcatcaggt

SEQ ID NO: 3791 - DNA, 46 bp, Artificial Sequence
  Synthesized adaptor oligonucleotide
  misc_feature (34)..(36): n is a, c, g, or t
tgcaggaccagagaattcgaatacactacacctnnntgcatcaggt

SEQ ID NO: 3792 - DNA, 46 bp, Artificial Sequence
  Synthesized adaptor oligonucleotide
  misc_feature (34)..(36): n is a, c, g, or t
tgcaggaccagagaattcgaatacattagagttnnntgcatcaggt

SEQ ID NO: 3793 - DNA, 46 bp, Artificial Sequence
  Synthesized adaptor oligonucleotide
  misc_feature (34)..(36): n is a, c, g, or t
tgcaggaccagagaattcgaatacaggtgttgtnnntgcatcaggt

SEQ ID NO: 3794 - DNA, 46 bp, Artificial Sequence
  Synthesized adaptor oligonucleotide
  misc_feature (34)..(36): n is a, c, g, or t
tgcaggaccagagaattcgaatacaccagacgcnnntgcatcaggt

SEQ ID NO: 3795 - DNA, 46 bp, Artificial Sequence
  Synthesized adaptor oligonucleotide
  misc_feature (34)..(36): n is a, c, g, or t
tgcaggaccagagaattcgaatacatgttggcannntgcatcaggt

SEQ ID NO: 3796 - DNA, 46 bp, Artificial Sequence
  Synthesized adaptor oligonucleotide
  misc_feature (34)..(36): n is a, c, g, or t
tgcaggaccagagaattcgaatacatcttcctcnnntgcatcaggt

SEQ ID NO: 3797 - DNA, 46 bp, Artificial Sequence
  Synthesized adaptor oligonucleotide
  misc_feature (34)..(36): n is a, c, g, or t
tgcaggaccagagaattcgaatacacaagataannntgcatcaggt

SEQ ID NO: 3798 - DNA, 46 bp, Artificial Sequence
  Synthesized adaptor oligonucleotide
  misc_feature (34)..(36): n is a, c, g, or t
tgcaggaccagagaattcgaatacatactagcgnnntgcatcaggt

SEQ ID NO: 3799 - DNA, 46 bp, Artificial Sequence
  Synthesized adaptor oligonucleotide
  misc_feature (34)..(36): n is a, c, g, or t
tgcaggaccagagaattcgaatacagacacaagnnntgcatcaggt

SEQ ID NO: 3800 - DNA, 46 bp, Artificial Sequence
  Synthesized adaptor oligonucleotide
  misc_feature (34)..(36): n is a, c, g, or t
tgcaggaccagagaattcgaatacagttacctcnnntgcatcaggt

SEQ ID NO: 3801 - DNA, 46 bp, Artificial Sequence
  Synthesized adaptor oligonucleotide
  misc_feature (34)..(36): n is a, c, g, or t
tgcaggaccagagaattcgaatacatctaccacnnntgcatcaggt

SEQ ID NO: 3802 - DNA, 46 bp, Artificial Sequence
  Synthesized adaptor oligonucleotide
  misc_feature (34)..(36): n is a, c, g, or t
tgcaggaccagagaattcgaatacatagtcgtgnnntgcatcaggt

SEQ ID NO: 3803 - DNA, 46 bp, Artificial Sequence
  Synthesized adaptor oligonucleotide
  misc_feature (34)..(36): n is a, c, g, or t
tgcaggaccagagaattcgaatacaaatgcaggnnntgcatcaggt

SEQ ID NO: 3804 - DNA, 46 bp, Artificial Sequence
  Synthesized adaptor oligonucleotide
  misc_feature (34)..(36): n is a, c, g, or t
tgcaggaccagagaattcgaatacacatggactnnntgcatcaggt

SEQ ID NO: 3805 - DNA, 46 bp, Artificial Sequence
  Synthesized adaptor oligonucleotide
  misc_feature (34)..(36): n is a, c, g, or t
tgcaggaccagagaattcgaatacattgcgagtnnntgcatcaggt

SEQ ID NO: 3806 - DNA, 46 bp, Artificial Sequence
  Synthesized adaptor oligonucleotide
  misc_feature (34)..(36): n is a, c, g, or t
tgcaggaccagagaattcgaatacattgcaagcnnntgcatcaggt

SEQ ID NO: 3807 - DNA, 46 bp, Artificial Sequence
  Synthesized adaptor oligonucleotide
  misc_feature (34)..(36): n is a, c, g, or t
tgcaggaccagagaattcgaatacacctcggagnnntgcatcaggt

SEQ ID NO: 3808 - DNA, 46 bp, Artificial Sequence
  Synthesized adaptor oligonucleotide
  misc_feature (34)..(36): n is a, c, g, or t
tgcaggaccagagaattcgaatacataacattgnnntgcatcaggt

SEQ ID NO: 3809 - DNA, 46 bp, Artificial Sequence
  Synthesized adaptor oligonucleotide
  misc_feature (34)..(36): n is a, c, g, or t
tgcaggaccagagaattcgaatacagaggttagnnntgcatcaggt

SEQ ID NO: 3810 - DNA, 46 bp, Artificial Sequence
  Synthesized adaptor oligonucleotide
  misc_feature (34)..(36): n is a, c, g, or t
tgcaggaccagagaattcgaatacaagaaactannntgcatcaggt

SEQ ID NO: 3811 - DNA, 46 bp, Artificial Sequence
  Synthesized adaptor oligonucleotide
  misc_feature (34)..(36): n is a, c, g, or t
tgcaggaccagagaattcgaatacatccacctannntgcatcaggt

SEQ ID NO: 3812 - DNA, 46 bp, Artificial Sequence
  Synthesized adaptor oligonucleotide
  misc_feature (34)..(36): n is a, c, g, or t
tgcaggaccagagaattcgaatacatccttcctnnntgcatcaggt

SEQ ID NO: 3813 - DNA, 46 bp, Artificial Sequence
  Synthesized adaptor oligonucleotide
  misc_feature (34)..(36): n is a, c, g, or t
tgcaggaccagagaattcgaatacaaactccgannntgcatcaggt

SEQ ID NO: 3814 - DNA, 46 bp, Artificial Sequence
  Synthesized adaptor oligonucleotide
  misc_feature (34)..(36): n is a, c, g, or t
tgcaggaccagagaattcgaatacaaattagctnnntgcatcaggt

SEQ ID NO: 3815 - DNA, 46 bp, Artificial Sequence
  Synthesized adaptor oligonucleotide
  misc_feature (34)..(36): n is a, c, g, or t
tgcaggaccagagaattcgaatacaatagtaagnnntgcatcaggt

SEQ ID NO: 3816 - DNA, 46 bp, Artificial Sequence
  Synthesized adaptor oligonucleotide
  misc_feature (34)..(36): n is a, c, g, or t
tgcaggaccagagaattcgaatacagttttactnnntgcatcaggt

SEQ ID NO: 3817 - DNA, 46 bp, Artificial Sequence
  Synthesized adaptor oligonucleotide
  misc_feature (34)..(36): n is a, c, g, or t
tgcaggaccagagaattcgaatacacgcaattgnnntgcatcaggt

SEQ ID NO: 3818 - DNA, 46 bp, Artificial Sequence
  Synthesized adaptor oligonucleotide
  misc_feature (34)..(36): n is a, c, g, or t
tgcaggaccagagaattcgaatacaggaggcgtnnntgcatcaggt

SEQ ID NO: 3819 - DNA, 46 bp, Artificial Sequence
  Synthesized adaptor oligonucleotide
  misc_feature (34)..(36): n is a, c, g, or t
tgcaggaccagagaattcgaatacagtaactgcnnntgcatcaggt

SEQ ID NO: 3820 - DNA, 46 bp, Artificial Sequence
  Synthesized adaptor oligonucleotide
  misc_feature (34)..(36): n is a, c, g, or t
tgcaggaccagagaattcgaatacatgtcaacgnnntgcatcaggt

SEQ ID NO: 3821 - DNA, 46 bp, Artificial Sequence
  Synthesized adaptor oligonucleotide
  misc_feature (34)..(36): n is a, c, g, or t
tgcaggaccagagaattcgaatacacgatttttnnntgcatcaggt

SEQ ID NO: 3822 - DNA, 46 bp, Artificial Sequence
  Synthesized adaptor oligonucleotide
  misc_feature (34)..(36): n is a, c, g, or t
tgcaggaccagagaattcgaatacaccgtattcnnntgcatcaggt

SEQ ID NO: 3823 - DNA, 46 bp, Artificial Sequence
  Synthesized adaptor oligonucleotide
  misc_feature (34)..(36): n is a, c, g, or t
tgcaggaccagagaattcgaatacagccgcgatnnntgcatcaggt

SEQ ID NO: 3824 - DNA, 46 bp, Artificial Sequence
  Synthesized adaptor oligonucleotide
  misc_feature (34)..(36): n is a, c, g, or t
tgcaggaccagagaattcgaatacaggccctagnnntgcatcaggt

SEQ ID NO: 3825 - DNA, 46 bp, Artificial Sequence
  Synthesized adaptor oligonucleotide
  misc_feature (34)..(36): n is a, c, g, or t
tgcaggaccagagaattcgaatacaaacaggcannntgcatcaggt

SEQ ID NO: 3826 - DNA, 46 bp, Artificial Sequence
  Synthesized adaptor oligonucleotide
  misc_feature (34)..(36): n is a, c, g, or t
tgcaggaccagagaattcgaatacaacctatggnnntgcatcaggt

SEQ ID NO: 3827 - DNA, 46 bp, Artificial Sequence
  Synthesized adaptor oligonucleotide
  misc_feature (34)..(36): n is a, c, g, or t
tgcaggaccagagaattcgaatacatgtgtcgannntgcatcaggt

SEQ ID NO: 3828 - DNA, 46 bp, Artificial Sequence
  Synthesized adaptor oligonucleotide
  misc_feature (34)..(36): n is a, c, g, or t
tgcaggaccagagaattcgaatacagtggattcnnntgcatcaggt

SEQ ID NO: 3829 - DNA, 46 bp, Artificial Sequence
  Synthesized adaptor oligonucleotide
  misc_feature (34)..(36): n is a, c, g, or t
tgcaggaccagagaattcgaatacatcggaccgnnntgcatcaggt

SEQ ID NO: 3830 - DNA, 46 bp, Artificial Sequence
  Synthesized adaptor oligonucleotide
  misc_feature (34)..(36): n is a, c, g, or t
tgcaggaccagagaattcgaatacaaaacatagnnntgcatcaggt

SEQ ID NO: 3831 - DNA, 46 bp, Artificial Sequence
  Synthesized adaptor oligonucleotide
  misc_feature (34)..(36): n is a, c, g, or t
tgcaggaccagagaattcgaatacaagaagcgtnnntgcatcaggt

SEQ ID NO: 3832 - DNA, 46 bp, Artificial Sequence
  Synthesized adaptor oligonucleotide
  misc_feature (34)..(36): n is a, c, g, or t
tgcaggaccagagaattcgaatacaccctcacgnnntgcatcaggt

SEQ ID NO: 3833 - DNA, 46 bp, Artificial Sequence
  Synthesized adaptor oligonucleotide
  misc_feature (34)..(36): n is a, c, g, or t
tgcaggaccagagaattcgaatacaaactgtcgnnntgcatcaggt

SEQ ID NO: 3834 - DNA, 46 bp, Artificial Sequence
  Synthesized adaptor oligonucleotide
  misc_feature (34)..(36): n is a, c, g, or t
tgcaggaccagagaattcgaatacatcttggagnnntgcatcaggt

SEQ ID NO: 3835 - DNA, 46 bp, Artificial Sequence
  Synthesized adaptor oligonucleotide
  misc_feature (34)..(36): n is a, c, g, or t
tgcaggaccagagaattcgaatacagtgaaatannntgcatcaggt

SEQ ID NO: 3836 - DNA, 46 bp, Artificial Sequence
  Synthesized adaptor oligonucleotide
  misc_feature (34)..(36): n is a, c, g, or t
tgcaggaccagagaattcgaatacatgcttctgnnntgcatcaggt

SEQ ID NO: 3837 - DNA, 46 bp, Artificial Sequence
  Synthesized adaptor oligonucleotide
  misc_feature (34)..(36): n is a, c, g, or t
tgcaggaccagagaattcgaatacatgacttccnnntgcatcaggt

SEQ ID NO: 3838 - DNA, 46 bp, Artificial Sequence
  Synthesized adaptor oligonucleotide
  misc_feature (34)..(36): n is a, c, g, or t
tgcaggaccagagaattcgaatacacccggatgnnntgcatcaggt

SEQ ID NO: 3839 - DNA, 46 bp, Artificial Sequence
  Synthesized adaptor oligonucleotide
  misc_feature (34)..(36): n is a, c, g, or t
tgcaggaccagagaattcgaatacagaggacatnnntgcatcaggt

SEQ ID NO: 3840 - DNA, 46 bp, Artificial Sequence
  Synthesized adaptor oligonucleotide
  misc_feature (34)..(36): n is a, c, g, or t
tgcaggaccagagaattcgaatacacaggtatcnnntgcatcaggt

SEQ ID NO: 3841 - DNA, 46 bp, Artificial Sequence
  Synthesized adaptor oligonucleotide
  misc_feature (34)..(36): n is a, c, g, or t
tgcaggaccagagaattcgaatacagtagtattnnntgcatcaggt

SEQ ID NO: 3842 - DNA, 46 bp, Artificial Sequence
  Synthesized adaptor oligonucleotide
  misc_feature (34)..(36): n is a, c, g, or t
tgcaggaccagagaattcgaatacaaaggaggannntgcatcaggt

SEQ ID NO: 3843 - DNA, 46 bp, Artificial Sequence
  Synthesized adaptor oligonucleotide
  misc_feature (34)..(36): n is a, c, g, or t
tgcaggaccagagaattcgaatacaaagagccannntgcatcaggt

SEQ ID NO: 3844 - DNA, 46 bp, Artificial Sequence
  Synthesized adaptor oligonucleotide
  misc_feature (34)..(36): n is a, c, g, or t
tgcaggaccagagaattcgaatacagtctctcannntgcatcaggt

SEQ ID NO: 3845 - DNA, 46 bp, Artificial Sequence
  Synthesized adaptor oligonucleotide
  misc_feature (34)..(36): n is a, c, g, or t
tgcaggaccagagaattcgaatacaacggtgttnnntgcatcaggt

SEQ ID NO: 3846 - DNA, 46 bp, Artificial Sequence
  Synthesized adaptor oligonucleotide
  misc_feature (34)..(36): n is a, c, g, or t
tgcaggaccagagaattcgaatacacgtacgatnnntgcatcaggt

SEQ ID NO: 3847 - DNA, 46 bp, Artificial Sequence
  Synthesized adaptor oligonucleotide
  misc_feature (34)..(36): n is a, c, g, or t
tgcaggaccagagaattcgaatacagaggtgtannntgcatcaggt

SEQ ID NO: 3848 - DNA, 46 bp, Artificial Sequence
  Synthesized adaptor oligonucleotide
  misc_feature (34)..(36): n is a, c, g, or t
tgcaggaccagagaattcgaatacacaccacaannntgcatcaggt

SEQ ID NO: 3849 - DNA, 46 bp, Artificial Sequence
  Synthesized adaptor oligonucleotide
  misc_feature (34)..(36): n is a, c, g, or t
tgcaggaccagagaattcgaatacaatttcccgnnnacgtatgcca

SEQ ID NO: 3850 - DNA, 46 bp, Artificial Sequence
  Synthesized adaptor oligonucleotide
  misc_feature (34)..(36): n is a, c, g, or t
tgcaggaccagagaattcgaatacaatcccagannnacgtatgcca

SEQ ID NO: 3851 - DNA, 46 bp, Artificial Sequence
  Synthesized adaptor oligonucleotide
  misc_feature (34)..(36): n is a, c, g, or t
tgcaggaccagagaattcgaatacacggagacgnnnacgtatgcca

SEQ ID NO: 3852 - DNA, 46 bp, Artificial Sequence
  Synthesized adaptor oligonucleotide
  misc_feature (34)..(36): n is a, c, g, or t
tgcaggaccagagaattcgaatacacgatacgtnnnacgtatgcca

SEQ ID NO: 3853 - DNA, 46 bp, Artificial Sequence
  Synthesized adaptor oligonucleotide
  misc_feature (34)..(36): n is a, c, g, or t
tgcaggaccagagaattcgaatacatcctgctannnacgtatgcca

SEQ ID NO: 3854 - DNA, 46 bp, Artificial Sequence
  Synthesized adaptor oligonucleotide
  misc_feature (34)..(36): n is a, c, g, or t
tgcaggaccagagaattcgaatacaaattacacnnnacgtatgcca

SEQ ID NO: 3855 - DNA, 46 bp, Artificial Sequence
  Synthesized adaptor oligonucleotide
  misc_feature (34)..(36): n is a, c, g, or t
tgcaggaccagagaattcgaatacatttccgacnnnacgtatgcca

SEQ ID NO: 3856 - DNA, 46 bp, Artificial Sequence
  Synthesized adaptor oligonucleotide
  misc_feature (34)..(36): n is a, c, g, or t
tgcaggaccagagaattcgaatacactccccctnnnacgtatgcca

SEQ ID NO: 3857 - DNA, 46 bp, Artificial Sequence
  Synthesized adaptor oligonucleotide
  misc_feature (34)..(36): n is a, c, g, or t
tgcaggaccagagaattcgaatacaacaattcannnacgtatgcca

SEQ ID NO: 3858 - DNA, 46 bp, Artificial Sequence
  Synthesized adaptor oligonucleotide
  misc_feature (34)..(36): n is a, c, g, or t
tgcaggaccagagaattcgaatacaagcagcggnnnacgtatgcca

SEQ ID NO: 3859 - DNA, 46 bp, Artificial Sequence
  Synthesized adaptor oligonucleotide
  misc_feature (34)..(36): n is a, c, g, or t
tgcaggaccagagaattcgaatacaatccgatgnnnacgtatgcca

SEQ ID NO: 3860 - DNA, 46 bp, Artificial Sequence
  Synthesized adaptor oligonucleotide
  misc_feature (34)..(36): n is a, c, g, or t
tgcaggaccagagaattcgaatacatacgcacannnacgtatgcca

SEQ ID NO: 3861 - DNA, 46 bp, Artificial Sequence
  Synthesized adaptor oligonucleotide
  misc_feature (34)..(36): n is a, c, g, or t
tgcaggaccagagaattcgaatacaccaccattnnnacgtatgcca

SEQ ID NO: 3862 - DNA, 46 bp, Artificial Sequence
  Synthesized adaptor oligonucleotide
  misc_feature (34)..(36): n is a, c, g, or t
tgcaggaccagagaattcgaatacaaaaggtcgnnnacgtatgcca

SEQ ID NO: 3863 - DNA, 46 bp, Artificial Sequence
  Synthesized adaptor oligonucleotide
  misc_feature (34)..(36): n is a, c, g, or t
tgcaggaccagagaattcgaatacagcagtgttnnnacgtatgcca

SEQ ID NO: 3864 - DNA, 46 bp, Artificial Sequence
  Synthesized adaptor oligonucleotide
  misc_feature (34)..(36): n is a, c, g, or t
tgcaggaccagagaattcgaatacatcgaactgnnnacgtatgcca

SEQ ID NO: 3865 - DNA, 46 bp, Artificial Sequence
  Synthesized adaptor oligonucleotide
  misc_feature (34)..(36): n is a, c, g, or t
tgcaggaccagagaattcgaatacattcgctacnnnacgtatgcca

SEQ ID NO: 3866 - DNA, 46 bp, Artificial Sequence
  Synthesized adaptor oligonucleotide
  misc_feature (34)..(36): n is a, c, g, or t
tgcaggaccagagaattcgaatacatattcatcnnnacgtatgcca

SEQ ID NO: 3867 - DNA, 46 bp, Artificial Sequence
  Synthesized adaptor oligonucleotide
  misc_feature (34)..(36): n is a, c, g, or t
tgcaggaccagagaattcgaatacaaaactactnnnacgtatgcca

SEQ ID NO: 3868 - DNA, 46 bp, Artificial Sequence
  Synthesized adaptor oligonucleotide
  misc_feature (34)..(36): n is a, c, g, or t
tgcaggaccagagaattcgaatacagcccgtagnnnacgtatgcca

SEQ ID NO: 3869 - DNA, 46 bp, Artificial Sequence
  Synthesized adaptor oligonucleotide
  misc_feature (34)..(36): n is a, c, g, or t
tgcaggaccagagaattcgaatacaagtcgttgnnnacgtatgcca

SEQ ID NO: 3870 - DNA, 46 bp, Artificial Sequence
  Synthesized adaptor oligonucleotide
  misc_feature (34)..(36): n is a, c, g, or t
tgcaggaccagagaattcgaatacatgacagctnnnacgtatgcca

SEQ ID NO: 3871 - DNA, 46 bp, Artificial Sequence
  Synthesized adaptor oligonucleotide
  misc_feature (34)..(36): n is a, c, g, or t
tgcaggaccagagaattcgaatacatcagcgatnnnacgtatgcca

SEQ ID NO: 3872 - DNA, 46 bp, Artificial Sequence
  Synthesized adaptor oligonucleotide
  misc_feature (34)..(36): n is a, c, g, or t
tgcaggaccagagaattcgaatacagagtaaatnnnacgtatgcca

SEQ ID NO: 3873 - DNA, 46 bp, Artificial Sequence
  Synthesized adaptor oligonucleotide
  misc_feature (34)..(36): n is a, c, g, or t
tgcaggaccagagaattcgaatacagctgcctcnnnacgtatgcca

SEQ ID NO: 3874 - DNA, 46 bp, Artificial Sequence
  Synthesized adaptor oligonucleotide
  misc_feature (34)..(36): n is a, c, g, or t
tgcaggaccagagaattcgaatacacttgacgannnacgtatgcca

SEQ ID NO: 3875 - DNA, 46 bp, Artificial Sequence
  Synthesized adaptor oligonucleotide
  misc_feature (34)..(36): n is a, c, g, or t
tgcaggaccagagaattcgaatacacctctttcnnnacgtatgcca

SEQ ID NO: 3876 - DNA, 46 bp, Artificial Sequence
  Synthesized adaptor oligonucleotide
  misc_feature (34)..(36): n is a, c, g, or t
tgcaggaccagagaattcgaatacaacacaaggnnnacgtatgcca

SEQ ID NO: 3877 - DNA, 46 bp, Artificial Sequence
  Synthesized adaptor oligonucleotide
  misc_feature (34)..(36): n is a, c, g, or t
tgcaggaccagagaattcgaatacatctccagtnnnacgtatgcca

SEQ ID NO: 3878 - DNA, 46 bp, Artificial Sequence
  Synthesized adaptor oligonucleotide
  misc_feature (34)..(36): n is a, c, g, or t
tgcaggaccagagaattcgaatacatattggtannnacgtatgcca

SEQ ID NO: 3879 - DNA, 46 bp, Artificial Sequence
  Synthesized adaptor oligonucleotide
  misc_feature (34)..(36): n is a, c, g, or t
tgcaggaccagagaattcgaatacagcttcatcnnnacgtatgcca

SEQ ID NO: 3880 - DNA, 46 bp, Artificial Sequence
  Synthesized adaptor oligonucleotide
  misc_feature (34)..(36): n is a, c, g, or t
tgcaggaccagagaattcgaatacattcgtttannnacgtatgcca

SEQ ID NO: 3881 - DNA, 46 bp, Artificial Sequence
  Synthesized adaptor oligonucleotide
  misc_feature (34)..(36): n is a, c, g, or t
tgcaggaccagagaattcgaatacatacgtgacnnnacgtatgcca

SEQ ID NO: 3882 - DNA, 46 bp, Artificial Sequence
  Synthesized adaptor oligonucleotide
  misc_feature (34)..(36): n is a, c, g, or t
tgcaggaccagagaattcgaatacatgttggtgnnnacgtatgcca

SEQ ID NO: 3883 - DNA, 46 bp, Artificial Sequence
  Synthesized adaptor oligonucleotide
  misc_feature (34)..(36): n is a, c, g, or t
tgcaggaccagagaattcgaatacacatcacagnnnacgtatgcca

SEQ ID NO: 3884 - DNA, 46 bp, Artificial Sequence
  Synthesized adaptor oligonucleotide
  misc_feature (34)..(36): n is a, c, g, or t
tgcaggaccagagaattcgaatacaaacggcggnnnacgtatgcca

SEQ ID NO: 3885 - DNA, 46 bp, Artificial Sequence
  Synthesized adaptor oligonucleotide
  misc_feature (34)..(36): n is a, c, g, or t
tgcaggaccagagaattcgaatacaaatgtgaannnacgtatgcca

SEQ ID NO: 3886 - DNA, 46 bp, Artificial Sequence
  Synthesized adaptor oligonucleotide
  misc_feature (34)..(36): n is a, c, g, or t
tgcaggaccagagaattcgaatacagtagccgcnnnacgtatgcca

SEQ ID NO: 3887 - DNA, 46 bp, Artificial Sequence
  Synthesized adaptor oligonucleotide
  misc_feature (34)..(36): n is a, c, g, or t
tgcaggaccagagaattcgaatacatgtgaattnnnacgtatgcca

SEQ ID NO: 3888 - DNA, 46 bp, Artificial Sequence
  Synthesized adaptor oligonucleotide
  misc_feature (34)..(36): n is a, c, g, or t
tgcaggaccagagaattcgaatacacggtaagannnacgtatgcca

SEQ ID NO: 3889 - DNA, 46 bp, Artificial Sequence
  Synthesized adaptor oligonucleotide
  misc_feature (34)..(36): n is a, c, g, or t
tgcaggaccagagaattcgaatacatctggtgannnacgtatgcca

SEQ ID NO: 3890 - DNA, 46 bp, Artificial Sequence
  Synthesized adaptor oligonucleotide
  misc_feature (34)..(36): n is a, c, g, or t
tgcaggaccagagaattcgaatacagtccgtttnnnacgtatgcca

SEQ ID NO: 3891 - DNA, 46 bp, Artificial Sequence
  Synthesized adaptor oligonucleotide
  misc_feature (34)..(36): n is a, c, g, or t
tgcaggaccagagaattcgaatacaccgtcgagnnnacgtatgcca

SEQ ID NO: 3892 - DNA, 46 bp, Artificial Sequence
  Synthesized adaptor oligonucleotide
  misc_feature (34)..(36): n is a, c, g, or t
tgcaggaccagagaattcgaatacatcgatcctnnnacgtatgcca

SEQ ID NO: 3893 - DNA, 46 bp, Artificial Sequence
  Synthesized adaptor oligonucleotide
  misc_feature (34)..(36): n is a, c, g, or t
tgcaggaccagagaattcgaatacatttgcgtcnnnacgtatgcca

SEQ ID NO: 3894 - DNA, 46 bp, Artificial Sequence
  Synthesized adaptor oligonucleotide
  misc_feature (34)..(36): n is a, c, g, or t
tgcaggaccagagaattcgaatacactcggctcnnnacgtatgcca

SEQ ID NO: 3895 - DNA, 46 bp, Artificial Sequence
  Synthesized adaptor oligonucleotide
  misc_feature (34)..(36): n is a, c, g, or t
tgcaggaccagagaattcgaatacatccacgccnnnacgtatgcca

SEQ ID NO: 3896 - DNA, 46 bp, Artificial Sequence
  Synthesized adaptor oligonucleotide
  misc_feature (34)..(36): n is a, c, g, or t
tgcaggaccagagaattcgaatacaacgtgccgnnnacgtatgcca

SEQ ID NO: 3897 - DNA, 46 bp, Artificial Sequence
  Synthesized adaptor oligonucleotide
  misc_feature (34)..(36): n is a, c, g, or t
tgcaggaccagagaattcgaatacatgtggtacnnnacgtatgcca

SEQ ID NO: 3898 - DNA, 46 bp, Artificial Sequence
  Synthesized adaptor oligonucleotide
  misc_feature (34)..(36): n is a, c, g, or t
tgcaggaccagagaattcgaatacaagccgaaannnacgtatgcca

SEQ ID NO: 3899 - DNA, 46 bp, Artificial Sequence
  Synthesized adaptor oligonucleotide
  misc_feature (34)..(36): n is a, c, g, or t
tgcaggaccagagaattcgaatacactcctaacnnnacgtatgcca

SEQ ID NO: 3900 - DNA, 46 bp, Artificial Sequence
  Synthesized adaptor oligonucleotide
  misc_feature (34)..(36): n is a, c, g, or t
tgcaggaccagagaattcgaatacagaaggcgcnnnacgtatgcca

SEQ ID NO: 3901 - DNA, 46 bp, Artificial Sequence
  Synthesized adaptor oligonucleotide
  misc_feature (34)..(36): n is a, c, g, or t
tgcaggaccagagaattcgaatacacgttcactnnnacgtatgcca

SEQ ID NO: 3902 - DNA, 46 bp, Artificial Sequence
  Synthesized adaptor oligonucleotide
  misc_feature (34)..(36): n is a, c, g, or t
tgcaggaccagagaattcgaatacagagatgtgnnnacgtatgcca

SEQ ID NO: 3903 - DNA, 46 bp, Artificial Sequence
  Synthesized adaptor oligonucleotide
  misc_feature (34)..(36): n is a, c, g, or t
tgcaggaccagagaattcgaatacagctcacttnnnacgtatgcca

SEQ ID NO: 3904 - DNA, 46 bp, Artificial Sequence
  Synthesized adaptor oligonucleotide
  misc_feature (34)..(36): n is a, c, g, or t
tgcaggaccagagaattcgaatacacgaagcttnnnacgtatgcca

SEQ ID NO: 3905 - DNA, 46 bp, Artificial Sequence
  Synthesized adaptor oligonucleotide
  misc_feature (34)..(36): n is a, c, g, or t
tgcaggaccagagaattcgaatacatactcgagnnnacgtatgcca

SEQ ID NO: 3906 - DNA, 46 bp, Artificial Sequence
  Synthesized adaptor oligonucleotide
  misc_feature (34)..(36): n is a, c, g, or t
tgcaggaccagagaattcgaatacattcttgtannnacgtatgcca

SEQ ID NO: 3907 - DNA, 46 bp, Artificial Sequence
  Synthesized adaptor oligonucleotide
  misc_feature (34)..(36): n is a, c, g, or t
tgcaggaccagagaattcgaatacagaagaaggnnnacgtatgcca

SEQ ID NO: 3908 - DNA, 46 bp, Artificial Sequence
  Synthesized adaptor oligonucleotide
  misc_feature (34)..(36): n is a, c, g, or t
tgcaggaccagagaattcgaatacaagccacgcnnnacgtatgcca

SEQ ID NO: 3909 - DNA, 46 bp, Artificial Sequence
  Synthesized adaptor oligonucleotide
  misc_feature (34)..(36): n is a, c, g, or t
tgcaggaccagagaattcgaatacactatacggnnnctagcgttac

SEQ ID NO: 3910 - DNA, 46 bp, Artificial Sequence
  Synthesized adaptor oligonucleotide
  misc_feature (34)..(36): n is a, c, g, or t
tgcaggaccagagaattcgaatacaagatcttannnctagcgttac

SEQ ID NO: 3911 - DNA, 46 bp, Artificial Sequence
  Synthesized adaptor oligonucleotide
  misc_feature (34)..(36): n is a, c, g, or t
tgcaggaccagagaattcgaatacaacaacccannnctagcgttac

SEQ ID NO: 3912 - DNA, 46 bp, Artificial Sequence
  Synthesized adaptor oligonucleotide
  misc_feature (34)..(36): n is a, c, g, or t
tgcaggaccagagaattcgaatacatgctaacgnnnctagcgttac

SEQ ID NO: 3913 - DNA, 46 bp, Artificial Sequence
  Synthesized adaptor oligonucleotide
  misc_feature (34)..(36): n is a, c, g, or t
tgcaggaccagagaattcgaatacatgtagtcgnnnctagcgttac

SEQ ID NO: 3914 - DNA, 46 bp, Artificial Sequence
  Synthesized adaptor oligonucleotide
  misc_feature (34)..(36): n is a, c, g, or t
tgcaggaccagagaattcgaatacaatggtcgtnnnctagcgttac

SEQ ID NO: 3915 - DNA, 46 bp, Artificial Sequence
  Synthesized adaptor oligonucleotide
  misc_feature (34)..(36): n is a, c, g, or t
tgcaggaccagagaattcgaatacaagtaggacnnnctagcgttac

SEQ ID NO: 3916 - DNA, 46 bp, Artificial Sequence
  Synthesized adaptor oligonucleotide
  misc_feature (34)..(36): n is a, c, g, or t
tgcaggaccagagaattcgaatacaaaaaaaaannnctagcgttac

SEQ ID NO: 3917 - DNA, 46 bp, Artificial Sequence
  Synthesized adaptor oligonucleotide
  misc_feature (34)..(36): n is a, c, g, or t
tgcaggaccagagaattcgaatacaagttcatannnctagcgttac

SEQ ID NO: 3918 - DNA, 46 bp, Artificial Sequence
  Synthesized adaptor oligonucleotide
  misc_feature (34)..(36): n is a, c, g, or t
tgcaggaccagagaattcgaatacagaaggtcannnctagcgttac

SEQ ID NO: 3919 - DNA, 46 bp, Artificial Sequence
  Synthesized adaptor oligonucleotide
  misc_feature (34)..(36): n is a, c, g, or t
tgcaggaccagagaattcgaatacatgaatgccnnnctagcgttac

SEQ ID NO: 3920 - DNA, 46 bp, Artificial Sequence
  Synthesized adaptor oligonucleotide
  misc_feature (34)..(36): n is a, c, g, or t
tgcaggaccagagaattcgaatacaacacccggnnnctagcgttac

SEQ ID NO: 3921 - DNA, 46 bp, Artificial Sequence
  Synthesized adaptor oligonucleotide
  misc_feature (34)..(36): n is a, c, g, or t
tgcaggaccagagaattcgaatacactaacgcannnctagcgttac

SEQ ID NO: 3922 - DNA, 46 bp, Artificial Sequence
  Synthesized adaptor oligonucleotide
  misc_feature (34)..(36): n is a, c, g, or t
tgcaggaccagagaattcgaatacaacccctatnnnctagcgttac

SEQ ID NO: 3923 - DNA, 46 bp, Artificial Sequence
  Synthesized adaptor oligonucleotide
  misc_feature (34)..(36): n is a, c, g, or t
tgcaggaccagagaattcgaatacaagatagatnnnctagcgttac

SEQ ID NO: 3924 - DNA, 46 bp, Artificial Sequence
  Synthesized adaptor oligonucleotide
  misc_feature (34)..(36): n is a, c, g, or t
tgcaggaccagagaattcgaatacaggagtgatnnnctagcgttac

SEQ ID NO: 3925 - DNA, 46 bp, Artificial Sequence
  Synthesized adaptor oligonucleotide
  misc_feature (34)..(36): n is a, c, g, or t
tgcaggaccagagaattcgaatacaatagaggcnnnctagcgttac

SEQ ID NO: 3926 - DNA, 46 bp, Artificial Sequence
  Synthesized adaptor oligonucleotide
  misc_feature (34)..(36): n is a, c, g, or t
tgcaggaccagagaattcgaatacaccccgcgcnnnctagcgttac

SEQ ID NO: 3927 - DNA, 46 bp, Artificial Sequence
  Synthesized adaptor oligonucleotide
  misc_feature (34)..(36): n is a, c, g, or t
tgcaggaccagagaattcgaatacaccatactcnnnctagcgttac

SEQ ID NO: 3928 - DNA, 46 bp, Artificial Sequence
  Synthesized adaptor oligonucleotide
  misc_feature (34)..(36): n is a, c, g, or t
tgcaggaccagagaattcgaatacatgattcccnnnctagcgttac

SEQ ID NO: 3929 - DNA, 46 bp, Artificial Sequence
  Synthesized adaptor oligonucleotide
  misc_feature (34)..(36): n is a, c, g, or t
tgcaggaccagagaattcgaatacaagaacggtnnnctagcgttac

SEQ ID NO: 3930 - DNA, 46 bp, Artificial Sequence
  Synthesized adaptor oligonucleotide
  misc_feature (34)..(36): n is a, c, g, or t
tgcaggaccagagaattcgaatacagcttcaagnnnctagcgttac

SEQ ID NO: 3931 - DNA, 46 bp, Artificial Sequence
  Synthesized adaptor oligonucleotide
  misc_feature (34)..(36): n is a, c, g, or t
tgcaggaccagagaattcgaatacaaaatatccnnnctagcgttac

SEQ ID NO: 3932 - DNA, 46 bp, Artificial Sequence
  Synthesized adaptor oligonucleotide
  misc_feature (34)..(36): n is a, c, g, or t
tgcaggaccagagaattcgaatacacgtccccannnctagcgttac

SEQ ID NO: 3933 - DNA, 46 bp, Artificial Sequence
  Synthesized adaptor oligonucleotide
  misc_feature (34)..(36): n is a, c, g, or t
tgcaggaccagagaattcgaatacaactaatcannnctagcgttac

SEQ ID NO: 3934 - DNA, 46 bp, Artificial Sequence
  Synthesized adaptor oligonucleotide
  misc_feature (34)..(36): n is a, c, g, or t
tgcaggaccagagaattcgaatacatgacgccgnnnctagcgttac

SEQ ID NO: 3935 - DNA, 46 bp, Artificial Sequence
  Synthesized adaptor oligonucleotide
  misc_feature (34)..(36): n is a, c, g, or t
tgcaggaccagagaattcgaatacagcgtgccannnctagcgttac

SEQ ID NO: 3936 - DNA, 46 bp, Artificial Sequence
  Synthesized adaptor oligonucleotide
  misc_feature (34)..(36): n is a, c, g, or t
tgcaggaccagagaattcgaatacaaaattggannnctagcgttac

SEQ ID NO: 3937 - DNA, 46 bp, Artificial Sequence
  Synthesized adaptor oligonucleotide
  misc_feature (34)..(36): n is a, c, g, or t
tgcaggaccagagaattcgaatacatgttcaccnnnctagcgttac

SEQ ID NO: 3938 - DNA, 46 bp, Artificial Sequence
  Synthesized adaptor oligonucleotide
  misc_feature (34)..(36): n is a, c, g, or t
tgcaggaccagagaattcgaatacaatccgcaannnctagcgttac

SEQ ID NO: 3939 - DNA, 46 bp, Artificial Sequence
  Synthesized adaptor oligonucleotide
  misc_feature (34)..(36): n is a, c, g, or t
tgcaggaccagagaattcgaatacatcagattannnctagcgttac

SEQ ID NO: 3940 - DNA, 46 bp, Artificial Sequence
  Synthesized adaptor oligonucleotide
  misc_feature (34)..(36): n is a, c, g, or t
tgcaggaccagagaattcgaatacacgctaagtnnnctagcgttac

SEQ ID NO: 3941 - DNA, 46 bp, Artificial Sequence
  Synthesized adaptor oligonucleotide
  misc_feature (34)..(36): n is a, c, g, or t
tgcaggaccagagaattcgaatacacacaccttnnnctagcgttac

SEQ ID NO: 3942 - DNA, 46 bp, Artificial Sequence
  Synthesized adaptor oligonucleotide
  misc_feature (34)..(36): n is a, c, g, or t
tgcaggaccagagaattcgaatacaaagcctgtnnnctagcgttac

SEQ ID NO: 3943 - DNA, 46 bp, Artificial Sequence
  Synthesized adaptor oligonucleotide
  misc_feature (34)..(36): n is a, c, g, or t
tgcaggaccagagaattcgaatacaggtccagcnnnctagcgttac

SEQ ID NO: 3944 - DNA, 46 bp, Artificial Sequence
  Synthesized adaptor oligonucleotide
  misc_feature (34)..(36): n is a, c, g, or t
tgcaggaccagagaattcgaatacatgtcgcttnnnctagcgttac

SEQ ID NO: 3945 - DNA, 46 bp, Artificial Sequence
  Synthesized adaptor oligonucleotide
  misc_feature (34)..(36): n is a, c, g, or t
tgcaggaccagagaattcgaatacagaaatttcnnnctagcgttac

SEQ ID NO: 3946 - DNA, 46 bp, Artificial Sequence
  Synthesized adaptor oligonucleotide
  misc_feature (34)..(36): n is a, c, g, or t
tgcaggaccagagaattcgaatacatacggtgtnnnctagcgttac

SEQ ID NO: 3947 - DNA, 46 bp, Artificial Sequence
  Synthesized adaptor oligonucleotide
  misc_feature (34)..(36): n is a, c, g, or t
tgcaggaccagagaattcgaatacaccgaccagnnnctagcgttac

SEQ ID NO: 3948 - DNA, 46 bp, Artificial Sequence
  Synthesized adaptor oligonucleotide
  misc_feature (34)..(36): n is a, c, g, or t
tgcaggaccagagaattcgaatacatgataaagnnnctagcgttac

SEQ ID NO: 3949 - DNA, 46 bp, Artificial Sequence
  Synthesized adaptor oligonucleotide
  misc_feature (34)..(36): n is a, c, g, or t
tgcaggaccagagaattcgaatacatatggctgnnnctagcgttac

SEQ ID NO: 3950 - DNA, 46 bp, Artificial Sequence
  Synthesized adaptor oligonucleotide
  misc_feature (34)..(36): n is a, c, g, or t
tgcaggaccagagaattcgaatacacccctcctnnnctagcgttac

SEQ ID NO: 3951 - DNA, 46 bp, Artificial Sequence
  Synthesized adaptor oligonucleotide
  misc_feature (34)..(36): n is a, c, g, or t
tgcaggaccagagaattcgaatacatcttaccgnnnctagcgttac

SEQ ID NO: 3952 - DNA, 46 bp, Artificial Sequence
  Synthesized adaptor oligonucleotide
  misc_feature (34)..(36): n is a, c, g, or t
tgcaggaccagagaattcgaatacagcaatcgtnnnctagcgttac

SEQ ID NO: 3953 - DNA, 46 bp, Artificial Sequence
  Synthesized adaptor oligonucleotide
  misc_feature (34)..(36): n is a, c, g, or t
tgcaggaccagagaattcgaatacactagcgcgnnnctagcgttac

SEQ ID NO: 3954 - DNA, 46 bp, Artificial Sequence
  Synthesized adaptor oligonucleotide
  misc_feature (34)..(36): n is a, c, g, or t
tgcaggaccagagaattcgaatacatactctgcnnnctagcgttac

SEQ ID NO: 3955 - DNA, 46 bp, Artificial Sequence
  Synthesized adaptor oligonucleotide
  misc_feature (34)..(36): n is a, c, g, or t
tgcaggaccagagaattcgaatacaatggcagannnctagcgttac

SEQ ID NO: 3956 - DNA, 46 bp, Artificial Sequence
  Synthesized adaptor oligonucleotide
  misc_feature (34)..(36): n is a, c, g, or t
tgcaggaccagagaattcgaatacacgaggtttnnnctagcgttac

SEQ ID NO: 3957 - DNA, 46 bp, Artificial Sequence
  Synthesized adaptor oligonucleotide
  misc_feature (34)..(36): n is a, c, g, or t
tgcaggaccagagaattcgaatacaccagctaannnctagcgttac

SEQ ID NO: 3958 - DNA, 46 bp, Artificial Sequence
  Synthesized adaptor oligonucleotide
  misc_feature (34)..(36): n is a, c, g, or t
tgcaggaccagagaattcgaatacatgtgccggnnnctagcgttac

SEQ ID NO: 3959 - DNA, 46 bp, Artificial Sequence
  Synthesized adaptor oligonucleotide
  misc_feature (34)..(36): n is a, c, g, or t
tgcaggaccagagaattcgaatacatgccgtttnnnctagcgttac

SEQ ID NO: 3960 - DNA, 46 bp, Artificial Sequence
  Synthesized adaptor oligonucleotide
  misc_feature (34)..(36): n is a, c, g, or t
tgcaggaccagagaattcgaatacactccgtgcnnnctagcgttac

SEQ ID NO: 3961 - DNA, 46 bp, Artificial Sequence
  Synthesized adaptor oligonucleotide
  misc_feature (34)..(36): n is a, c, g, or t
tgcaggaccagagaattcgaatacagcacaatcnnnctagcgttac

SEQ ID NO: 3962 - DNA, 46 bp, Artificial Sequence
  Synthesized adaptor oligonucleotide
  misc_feature (34)..(36): n is a, c, g, or t
tgcaggaccagagaattcgaatacacatcgtgannnctagcgttac

SEQ ID NO: 3963 - DNA, 46 bp, Artificial Sequence
  Synthesized adaptor oligonucleotide
  misc_feature (34)..(36): n is a, c, g, or t
tgcaggaccagagaattcgaatacacaaggttcnnnctagcgttac

SEQ ID NO: 3964 - DNA, 46 bp, Artificial Sequence
  Synthesized adaptor oligonucleotide
  misc_feature (34)..(36): n is a, c, g, or t
tgcaggaccagagaattcgaatacagaaaggtcnnnctagcgttac

SEQ ID NO: 3965 - DNA, 46 bp, Artificial Sequence
  Synthesized adaptor oligonucleotide
  misc_feature (34)..(36): n is a, c, g, or t
tgcaggaccagagaattcgaatacaagaaggtcnnnctagcgttac

SEQ ID NO: 3966 - DNA, 46 bp, Artificial Sequence
  Synthesized adaptor oligonucleotide
  misc_feature (34)..(36): n is a, c, g, or t
tgcaggaccagagaattcgaatacaccatgcttnnnctagcgttac

SEQ ID NO: 3967 - DNA, 46 bp, Artificial Sequence
  Synthesized adaptor oligonucleotide
  misc_feature (34)..(36): n is a, c, g, or t
tgcaggaccagagaattcgaatacattcaacttnnnctagcgttac

SEQ ID NO: 3968 - DNA, 46 bp, Artificial Sequence
  Synthesized adaptor oligonucleotide
  misc_feature (34)..(36): n is a, c, g, or t
tgcaggaccagagaattcgaatacatctggcaannnctagcgttac

SEQ ID NO: 3969 - DNA, 46 bp, Artificial Sequence
  Synthesized adaptor oligonucleotide
  misc_feature (34)..(36): n is a, c, g, or t
tgcaggaccagagaattcgaatacagtttacaannngatcgacatg

SEQ ID NO: 3970 - DNA, 46 bp, Artificial Sequence
  Synthesized adaptor oligonucleotide
  misc_feature (34)..(36): n is a, c, g, or t
tgcaggaccagagaattcgaatacaacccacaannngatcgacatg

SEQ ID NO: 3971 - DNA, 46 bp, Artificial Sequence
  Synthesized adaptor oligonucleotide
  misc_feature (34)..(36): n is a, c, g, or t
tgcaggaccagagaattcgaatacaggctcatannngatcgacatg

SEQ ID NO: 3972 - DNA, 46 bp, Artificial Sequence
  Synthesized adaptor oligonucleotide
  misc_feature (34)..(36): n is a, c, g, or t
tgcaggaccagagaattcgaatacaagcattgcnnngatcgacatg

SEQ ID NO: 3973 - DNA, 46 bp, Artificial Sequence
  Synthesized adaptor oligonucleotide
  misc_feature (34)..(36): n is a, c, g, or t
tgcaggaccagagaattcgaatacaaacccgatnnngatcgacatg

SEQ ID NO: 3974 - DNA, 46 bp, Artificial Sequence
  Synthesized adaptor oligonucleotide
  misc_feature (34)..(36): n is a, c, g, or t
tgcaggaccagagaattcgaatacatgaccaacnnngatcgacatg

SEQ ID NO: 3975 - DNA, 46 bp, Artificial Sequence
  Synthesized adaptor oligonucleotide
  misc_feature (34)..(36): n is a, c, g, or t
tgcaggaccagagaattcgaatacagccgaggannngatcgacatg

SEQ ID NO: 3976 - DNA, 46 bp, Artificial Sequence
  Synthesized adaptor oligonucleotide
  misc_feature (34)..(36): n is a, c, g, or t
tgcaggaccagagaattcgaatacaaatatggannngatcgacatg

SEQ ID NO: 3977 - DNA, 46 bp, Artificial Sequence
  Synthesized adaptor oligonucleotide
  misc_feature (34)..(36): n is a, c, g, or t
tgcaggaccagagaattcgaatacatttcggtcnnngatcgacatg

SEQ ID NO: 3978 - DNA, 46 bp, Artificial Sequence
  Synthesized adaptor oligonucleotide
  misc_feature (34)..(36): n is a, c, g, or t
tgcaggaccagagaattcgaatacattaggttannngatcgacatg

SEQ ID NO: 3979 - DNA, 46 bp, Artificial Sequence
  Synthesized adaptor oligonucleotide
  misc_feature (34)..(36): n is a, c, g, or t
tgcaggaccagagaattcgaatacaaacgcgttnnngatcgacatg

SEQ ID NO: 3980 - DNA, 46 bp, Artificial Sequence
  Synthesized adaptor oligonucleotide
  misc_feature (34)..(36): n is a, c, g, or t
tgcaggaccagagaattcgaatacaaggtaagcnnngatcgacatg

SEQ ID NO: 3981 - DNA, 46 bp, Artificial Sequence
  Synthesized adaptor oligonucleotide
  misc_feature (34)..(36): n is a, c, g, or t
tgcaggaccagagaattcgaatacaaattgactnnngatcgacatg

SEQ ID NO: 3982 - DNA, 46 bp, Artificial Sequence
  Synthesized adaptor oligonucleotide
  misc_feature (34)..(36): n is a, c, g, or t
tgcaggaccagagaattcgaatacatactgtaannngatcgacatg

SEQ ID NO: 3983 - DNA, 46 bp, Artificial Sequence
  Synthesized adaptor oligonucleotide
  misc_feature (34)..(36): n is a, c, g, or t
tgcaggaccagagaattcgaatacattctctggnnngatcgacatg

SEQ ID NO: 3984 - DNA, 46 bp, Artificial Sequence
  Synthesized adaptor oligonucleotide
  misc_feature (34)..(36): n is a, c, g, or t
tgcaggaccagagaattcgaatacaagaagaaannngatcgacatg

SEQ ID NO: 3985 - DNA, 46 bp, Artificial Sequence
  Synthesized adaptor oligonucleotide
  misc_feature (34)..(36): n is a, c, g, or t
tgcaggaccagagaattcgaatacaaaatgaacnnngatcgacatg

SEQ ID NO: 3986 - DNA, 46 bp, Artificial Sequence
  Synthesized adaptor oligonucleotide
  misc_feature (34)..(36): n is a, c, g, or t
tgcaggaccagagaattcgaatacaaacacaccnnngatcgacatg

SEQ ID NO: 3987 - DNA, 46 bp, Artificial Sequence
  Synthesized adaptor oligonucleotide
  misc_feature (34)..(36): n is a, c, g, or t
tgcaggaccagagaattcgaatacataaatgctnnngatcgacatg

SEQ ID NO: 3988 - DNA, 46 bp, Artificial Sequence
  Synthesized adaptor oligonucleotide
  misc_feature (34)..(36): n is a, c, g, or t
tgcaggaccagagaattcgaatacaaccggttannngatcgacatg

SEQ ID NO: 3989 - DNA, 46 bp, Artificial Sequence
  Synthesized adaptor oligonucleotide
  misc_feature (34)..(36): n is a, c, g, or t
tgcaggaccagagaattcgaatacaccggcgtannngatcgacatg

SEQ ID NO: 3990 - DNA, 46 bp, Artificial Sequence
  Synthesized adaptor oligonucleotide
  misc_feature (34)..(36): n is a, c, g, or t
tgcaggaccagagaattcgaatacacgtagactnnngatcgacatg

SEQ ID NO: 3991 - DNA, 46 bp, Artificial Sequence
  Synthesized adaptor oligonucleotide
  misc_feature (34)..(36): n is a, c, g, or t
tgcaggaccagagaattcgaatacaggaagtcannngatcgacatg

SEQ ID NO: 3992 - DNA, 46 bp, Artificial Sequence
  Synthesized adaptor oligonucleotide
  misc_feature (34)..(36): n is a, c, g, or t
tgcaggaccagagaattcgaatacaagaattgannngatcgacatg

SEQ ID NO: 3993 - DNA, 46 bp, Artificial Sequence
  Synthesized adaptor oligonucleotide
  misc_feature (34)..(36): n is a, c, g, or t
tgcaggaccagagaattcgaatacaaccccttannngatcgacatg

SEQ ID NO: 3994 - DNA, 46 bp, Artificial Sequence
  Synthesized adaptor oligonucleotide
  misc_feature (34)..(36): n is a, c, g, or t
tgcaggaccagagaattcgaatacatacagaccnnngatcgacatg

SEQ ID NO: 3995 - DNA, 46 bp, Artificial Sequence
  Synthesized adaptor oligonucleotide
  misc_feature (34)..(36): n is a, c, g, or t
tgcaggaccagagaattcgaatacaattagactnnngatcgacatg

SEQ ID NO: 3996 - DNA, 46 bp, Artificial Sequence
  Synthesized adaptor oligonucleotide
  misc_feature (34)..(36): n is a, c, g, or t
tgcaggaccagagaattcgaatacacactagacnnngatcgacatg

SEQ ID NO: 3997 - DNA, 46 bp, Artificial Sequence
  Synthesized adaptor oligonucleotide
  misc_feature (34)..(36): n is a, c, g, or t
tgcaggaccagagaattcgaatacagccctaaannngatcgacatg

SEQ ID NO: 3998 - DNA, 46 bp, Artificial Sequence
  Synthesized adaptor oligonucleotide
  misc_feature (34)..(36): n is a, c, g, or t
tgcaggaccagagaattcgaatacaagagtggtnnngatcgacatg

SEQ ID NO: 3999 - DNA, 46 bp, Artificial Sequence
  Synthesized adaptor oligonucleotide
  misc_feature (34)..(36): n is a, c, g, or t
tgcaggaccagagaattcgaatacaatctgaatnnngatcgacatg

SEQ ID NO: 4000 - DNA, 46 bp, Artificial Sequence
  Synthesized adaptor oligonucleotide
  misc_feature (34)..(36): n is a, c, g, or t
tgcaggaccagagaattcgaatacaagcatcacnnngatcgacatg

SEQ ID NO: 4001 - DNA, 46 bp, Artificial Sequence
  Synthesized adaptor oligonucleotide
  misc_feature (34)..(36): n is a, c, g, or t
tgcaggaccagagaattcgaatacaaattggaannngatcgacatg

SEQ ID NO: 4002 - DNA, 46 bp, Artificial Sequence
  Synthesized adaptor oligonucleotide
  misc_feature (34)..(36): n is a, c, g, or t
tgcaggaccagagaattcgaatacactagccccnnngatcgacatg

SEQ ID NO: 4003 - DNA, 46 bp, Artificial Sequence
  Synthesized adaptor oligonucleotide
  misc_feature (34)..(36): n is a, c, g, or t
tgcaggaccagagaattcgaatacatcttgctgnnngatcgacatg

SEQ ID NO: 4004 - DNA, 46 bp, Artificial Sequence
  Synthesized adaptor oligonucleotide
  misc_feature (34)..(36): n is a, c, g, or t
tgcaggaccagagaattcgaatacaccgtcctgnnngatcgacatg

SEQ ID NO: 4005 - DNA, 46 bp, Artificial Sequence
  Synthesized adaptor oligonucleotide
  misc_feature (34)..(36): n is a, c, g, or t
tgcaggaccagagaattcgaatacacctaacgannngatcgacatg

SEQ ID NO: 4006 - DNA, 46 bp, Artificial Sequence
  Synthesized adaptor oligonucleotide
  misc_feature (34)..(36): n is a, c, g, or t
tgcaggaccagagaattcgaatacaaaaatagcnnngatcgacatg

SEQ ID NO: 4007 - DNA, 46 bp, Artificial Sequence
  Synthesized adaptor oligonucleotide
  misc_feature (34)..(36): n is a, c, g, or t
tgcaggaccagagaattcgaatacaaagcactcnnngatcgacatg

SEQ ID NO: 4008 - DNA, 46 bp, Artificial Sequence
  Synthesized adaptor oligonucleotide
  misc_feature (34)..(36): n is a, c, g, or t
tgcaggaccagagaattcgaatacagttcaacgnnngatcgacatg

SEQ ID NO: 4009 - DNA, 46 bp, Artificial Sequence
  Synthesized adaptor oligonucleotide
  misc_feature (34)..(36): n is a, c, g, or t
tgcaggaccagagaattcgaatacacgtctgttnnngatcgacatg

SEQ ID NO: 4010 - DNA, 46 bp, Artificial Sequence
  Synthesized adaptor oligonucleotide
  misc_feature (34)..(36): n is a, c, g, or t
tgcaggaccagagaattcgaatacagcacggctnnngatcgacatg

SEQ ID NO: 4011 - DNA, 46 bp, Artificial Sequence
  Synthesized adaptor oligonucleotide
  misc_feature (34)..(36): n is a, c, g, or t
tgcaggaccagagaattcgaatacaacccaaacnnngatcgacatg

SEQ ID NO: 4012 - DNA, 46 bp, Artificial Sequence
  Synthesized adaptor oligonucleotide
  misc_feature (34)..(36): n is a, c, g, or t
tgcaggaccagagaattcgaatacacataaactnnngatcgacatg

SEQ ID NO: 4013 - DNA, 46 bp, Artificial Sequence
  Synthesized adaptor oligonucleotide
  misc_feature (34)..(36): n is a, c, g, or t
tgcaggaccagagaattcgaatacatcgtaagcnnngatcgacatg

SEQ ID NO: 4014 - DNA, 46 bp, Artificial Sequence
  Synthesized adaptor oligonucleotide
  misc_feature (34)..(36): n is a, c, g, or t
tgcaggaccagagaattcgaatacagagcttgtnnngatcgacatg

SEQ ID NO: 4015 - DNA, 46 bp, Artificial Sequence
  Synthesized adaptor oligonucleotide
  misc_feature (34)..(36): n is a, c, g, or t
tgcaggaccagagaattcgaatacagttttgttnnngatcgacatg

SEQ ID NO: 4016 - DNA, 46 bp, Artificial Sequence
  Synthesized adaptor oligonucleotide
  misc_feature (34)..(36): n is a, c, g, or t
tgcaggaccagagaattcgaatacatgagtaggnnngatcgacatg

SEQ ID NO: 4017 - DNA, 46 bp, Artificial Sequence
  Synthesized adaptor oligonucleotide
  misc_feature (34)..(36): n is a, c, g, or t
tgcaggaccagagaattcgaatacatgagtctgnnngatcgacatg

SEQ ID NO: 4018 - DNA, 46 bp, Artificial Sequence
  Synthesized adaptor oligonucleotide
  misc_feature (34)..(36): n is a, c, g, or t
tgcaggaccagagaattcgaatacaagaagctgnnngatcgacatg

SEQ ID NO: 4019 - DNA, 46 bp, Artificial Sequence
  Synthesized adaptor oligonucleotide
  misc_feature (34)..(36): n is a, c, g, or t
tgcaggaccagagaattcgaatacatagaagcgnnngatcgacatg

SEQ ID NO: 4020 - DNA, 46 bp, Artificial Sequence
  Synthesized adaptor oligonucleotide
  misc_feature (34)..(36): n is a, c, g, or t
tgcaggaccagagaattcgaatacagcttatggnnngatcgacatg

SEQ ID NO: 4021 - DNA, 46 bp, Artificial Sequence
  Synthesized adaptor oligonucleotide
  misc_feature (34)..(36): n is a, c, g, or t
tgcaggaccagagaattcgaatacaggcatatcnnngatcgacatg

SEQ ID NO: 4022 - DNA, 46 bp, Artificial Sequence
  Synthesized adaptor oligonucleotide
  misc_feature (34)..(36): n is a, c, g, or t
tgcaggaccagagaattcgaatacatccgcttannngatcgacatg

SEQ ID NO: 4023 - DNA, 46 bp, Artificial Sequence
  Synthesized adaptor oligonucleotide
  misc_feature (34)..(36): n is a, c, g, or t
tgcaggaccagagaattcgaatacatttataggnnngatcgacatg

SEQ ID NO: 4024 - DNA, 46 bp, Artificial Sequence
  Synthesized adaptor oligonucleotide
  misc_feature (34)..(36): n is a, c, g, or t
tgcaggaccagagaattcgaatacaatgcttaannngatcgacatg

SEQ ID NO: 4025 - DNA, 46 bp, Artificial Sequence
  Synthesized adaptor oligonucleotide
  misc_feature (34)..(36): n is a, c, g, or t
tgcaggaccagagaattcgaatacatgacgtacnnngatcgacatg

SEQ ID NO: 4026 - DNA, 46 bp, Artificial Sequence
  Synthesized adaptor oligonucleotide
  misc_feature (34)..(36): n is a, c, g, or t
tgcaggaccagagaattcgaatacaagagaaaannngatcgacatg

SEQ ID NO: 4027 - DNA, 46 bp, Artificial Sequence
  Synthesized adaptor oligonucleotide
  misc_feature (34)..(36): n is a, c, g, or t
tgcaggaccagagaattcgaatacatgtctcgtnnngatcgacatg

SEQ ID NO: 4028 - DNA, 46 bp, Artificial Sequence
  Synthesized adaptor oligonucleotide
  misc_feature (34)..(36): n is a, c, g, or t
tgcaggaccagagaattcgaatacacgttatggnnngatcgacatg

SEQ ID NO: 4029 - DNA, 46 bp, Artificial Sequence
  Synthesized adaptor oligonucleotide
  misc_feature (34)..(36): n is a, c, g, or t
tgcaggaccagagaattcgaatacatattgagtnnntgcatcaggt

SEQ ID NO: 4030 - DNA, 46 bp, Artificial Sequence
  Synthesized adaptor oligonucleotide
  misc_feature (34)..(36): n is a, c, g, or t
tgcaggaccagagaattcgaatacaaatagagtnnntgcatcaggt

SEQ ID NO: 4031 - DNA, 46 bp, Artificial Sequence
  Synthesized adaptor oligonucleotide
  misc_feature (34)..(36): n is a, c, g, or t
tgcaggaccagagaattcgaatacacagacatcnnntgcatcaggt

SEQ ID NO: 4032 - DNA, 46 bp, Artificial Sequence
  Synthesized adaptor oligonucleotide
  misc_feature (34)..(36): n is a, c, g, or t
tgcaggaccagagaattcgaatacagaagccaannntgcatcaggt

SEQ ID NO: 4033 - DNA, 46 bp, Artificial Sequence
  Synthesized adaptor oligonucleotide
  misc_feature (34)..(36): n is a, c, g, or t
tgcaggaccagagaattcgaatacacagtccaannntgcatcaggt

SEQ ID NO: 4034 - DNA, 46 bp, Artificial Sequence
  Synthesized adaptor oligonucleotide
  misc_feature (34)..(36): n is a, c, g, or t
tgcaggaccagagaattcgaatacattccgactnnntgcatcaggt

SEQ ID NO: 4035 - DNA, 46 bp, Artificial Sequence
  Synthesized adaptor oligonucleotide
  misc_feature (34)..(36): n is a, c, g, or t
tgcaggaccagagaattcgaatacaacagtattnnntgcatcaggt

SEQ ID NO: 4036 - DNA, 46 bp, Artificial Sequence
  Synthesized adaptor oligonucleotide
  misc_feature (34)..(36): n is a, c, g, or t
tgcaggaccagagaattcgaatacagagaatatnnntgcatcaggt

SEQ ID NO: 4037 - DNA, 46 bp, Artificial Sequence
  Synthesized adaptor oligonucleotide
  misc_feature (34)..(36): n is a, c, g, or t
tgcaggaccagagaattcgaatacaagtaaggcnnntgcatcaggt

SEQ ID NO: 4038 - DNA, 46 bp, Artificial Sequence
  Synthesized adaptor oligonucleotide
  misc_feature (34)..(36): n is a, c, g, or t
tgcaggaccagagaattcgaatacaagcgtatcnnntgcatcaggt

SEQ ID NO: 4039 - DNA, 46 bp, Artificial Sequence
  Synthesized adaptor oligonucleotide
  misc_feature (34)..(36): n is a, c, g, or t
tgcaggaccagagaattcgaatacatacggttgnnntgcatcaggt

SEQ ID NO: 4040 - DNA, 46 bp, Artificial Sequence
  Synthesized adaptor oligonucleotide
  misc_feature (34)..(36): n is a, c, g, or t
tgcaggaccagagaattcgaatacaaaggaaggnnntgcatcaggt

SEQ ID NO: 4041 - DNA, 46 bp, Artificial Sequence
  Synthesized adaptor oligonucleotide
  misc_feature (34)..(36): n is a, c, g, or t
tgcaggaccagagaattcgaatacacattggacnnntgcatcaggt

SEQ ID NO: 4042 - DNA, 46 bp, Artificial Sequence
  Synthesized adaptor oligonucleotide
  misc_feature (34)..(36): n is a, c, g, or t
tgcaggaccagagaattcgaatacataaggctcnnntgcatcaggt

SEQ ID NO: 4043 - DNA, 46 bp, Artificial Sequence
  Synthesized adaptor oligonucleotide
  misc_feature (34)..(36): n is a, c, g, or t
tgcaggaccagagaattcgaatacacgaagcggnnntgcatcaggt

SEQ ID NO: 4044 - DNA, 46 bp, Artificial Sequence
  Synthesized adaptor oligonucleotide
  misc_feature (34)..(36): n is a, c, g, or t
tgcaggaccagagaattcgaatacagacgattcnnntgcatcaggt

SEQ ID NO: 4045 - DNA, 46 bp, Artificial Sequence
  Synthesized adaptor oligonucleotide
  misc_feature (34)..(36): n is a, c, g, or t
tgcaggaccagagaattcgaatacagtcgatacnnntgcatcaggt

SEQ ID NO: 4046 - DNA, 46 bp, Artificial Sequence
  Synthesized adaptor oligonucleotide
  misc_feature (34)..(36): n is a, c, g, or t
tgcaggaccagagaattcgaatacacatcaatannntgcatcaggt

SEQ ID NO: 4047 - DNA, 46 bp, Artificial Sequence
  Synthesized adaptor oligonucleotide
  misc_feature (34)..(36): n is a, c, g, or t
tgcaggaccagagaattcgaatacacacacatgnnntgcatcaggt

SEQ ID NO: 4048 - DNA, 46 bp, Artificial Sequence
  Synthesized adaptor oligonucleotide
  misc_feature (34)..(36): n is a, c, g, or t
tgcaggaccagagaattcgaatacagcagcgagnnntgcatcaggt

SEQ ID NO: 4049 - DNA, 46 bp, Artificial Sequence
  Synthesized adaptor oligonucleotide
  misc_feature (34)..(36): n is a, c, g, or t
tgcaggaccagagaattcgaatacatacggctannntgcatcaggt

SEQ ID NO: 4050 - DNA, 46 bp, Artificial Sequence
  Synthesized adaptor oligonucleotide
  misc_feature (34)..(36): n is a, c, g, or t
tgcaggaccagagaattcgaatacacagcagaannntgcatcaggt

SEQ ID NO: 4051 - DNA, 46 bp, Artificial Sequence
  Synthesized adaptor oligonucleotide
  misc_feature (34)..(36): n is a, c, g, or t
tgcaggaccagagaattcgaatacaaagattagnnntgcatcaggt

SEQ ID NO: 4052 - DNA, 46 bp, Artificial Sequence
  Synthesized adaptor oligonucleotide
  misc_feature (34)..(36): n is a, c, g, or t
tgcaggaccagagaattcgaatacagcaaagacnnntgcatcaggt

SEQ ID NO: 4053 - DNA, 46 bp, Artificial Sequence
  Synthesized adaptor oligonucleotide
  misc_feature (34)..(36): n is a, c, g, or t
tgcaggaccagagaattcgaatacaataaacagnnntgcatcaggt

SEQ ID NO: 4054 - DNA, 46 bp, Artificial Sequence
  Synthesized adaptor oligonucleotide
  misc_feature (34)..(36): n is a, c, g, or t
tgcaggaccagagaattcgaatacattccaaaannntgcatcaggt

SEQ ID NO: 4055 - DNA, 46 bp, Artificial Sequence
  Synthesized adaptor oligonucleotide
  misc_feature (34)..(36): n is a, c, g, or t
tgcaggaccagagaattcgaatacatggtatcgnnntgcatcaggt

SEQ ID NO: 4056 - DNA, 46 bp, Artificial Sequence
  Synthesized adaptor oligonucleotide
  misc_feature (34)..(36): n is a, c, g, or t
tgcaggaccagagaattcgaatacaaacacttannntgcatcaggt

SEQ ID NO: 4057 - DNA, 46 bp, Artificial Sequence
  Synthesized adaptor oligonucleotide
  misc_feature (34)..(36): n is a, c, g, or t
tgcaggaccagagaattcgaatacaaccgtggcnnntgcatcaggt

SEQ ID NO: 4058 - DNA, 46 bp, Artificial Sequence
  Synthesized adaptor oligonucleotide
  misc_feature (34)..(36): n is a, c, g, or t
tgcaggaccagagaattcgaatacaagtctagcnnntgcatcaggt

SEQ ID NO: 4059 - DNA, 46 bp, Artificial Sequence
  Synthesized adaptor oligonucleotide
  misc_feature (34)..(36): n is a, c, g, or t
tgcaggaccagagaattcgaatacaagactccannntgcatcaggt

SEQ ID NO: 4060 - DNA, 46 bp, Artificial Sequence
  Synthesized adaptor oligonucleotide
  misc_feature (34)..(36): n is a, c, g, or t
tgcaggaccagagaattcgaatacaccaggattnnntgcatcaggt

SEQ ID NO: 4061 - DNA, 46 bp, Artificial Sequence
  Synthesized adaptor oligonucleotide
  misc_feature (34)..(36): n is a, c, g, or t
tgcaggaccagagaattcgaatacaagaatgatnnntgcatcaggt

SEQ ID NO: 4062 - DNA, 46 bp, Artificial Sequence
  Synthesized adaptor oligonucleotide
  misc_feature (34)..(36): n is a, c, g, or t
tgcaggaccagagaattcgaatacaacgacatcnnntgcatcaggt

SEQ ID NO: 4063 - DNA, 46 bp, Artificial Sequence
  Synthesized adaptor oligonucleotide
  misc_feature (34)..(36): n is a, c, g, or t
tgcaggaccagagaattcgaatacagtaaaaacnnntgcatcaggt

SEQ ID NO: 4064 - DNA, 46 bp, Artificial Sequence
  Synthesized adaptor oligonucleotide
  misc_feature (34)..(36): n is a, c, g, or t
tgcaggaccagagaattcgaatacaattaacacnnntgcatcaggt

SEQ ID NO: 4065 - DNA, 46 bp, Artificial Sequence
  Synthesized adaptor oligonucleotide
  misc_feature (34)..(36): n is a, c, g, or t
tgcaggaccagagaattcgaatacaacaaattcnnntgcatcaggt

SEQ ID NO: 4066 - DNA, 46 bp, Artificial Sequence
  Synthesized adaptor oligonucleotide
  misc_feature (34)..(36): n is a, c, g, or t
tgcaggaccagagaattcgaatacacgtccattnnntgcatcaggt

SEQ ID NO: 4067 - DNA, 46 bp, Artificial Sequence
  Synthesized adaptor oligonucleotide
  misc_feature (34)..(36): n is a, c, g, or t
tgcaggaccagagaattcgaatacaagaaatcannntgcatcaggt

SEQ ID NO: 4068 - DNA, 46 bp, Artificial Sequence
  Synthesized adaptor oligonucleotide
  misc_feature (34)..(36): n is a, c, g, or t
tgcaggaccagagaattcgaatacaaaatcactnnntgcatcaggt

SEQ ID NO: 4069 - DNA, 46 bp, Artificial Sequence
  Synthesized adaptor oligonucleotide
  misc_feature (34)..(36): n is a, c, g, or t
tgcaggaccagagaattcgaatacactccacgcnnntgcatcaggt

SEQ ID NO: 4070 - DNA, 46 bp, Artificial Sequence
  Synthesized adaptor oligonucleotide
  misc_feature (34)..(36): n is a, c, g, or t
tgcaggaccagagaattcgaatacagaataatgnnntgcatcaggt

SEQ ID NO: 4071 - DNA, 46 bp, Artificial Sequence
  Synthesized adaptor oligonucleotide
  misc_feature (34)..(36): n is a, c, g, or t
tgcaggaccagagaattcgaatacatgtgaccannntgcatcaggt

SEQ ID NO: 4072 - DNA, 46 bp, Artificial Sequence
  Synthesized adaptor oligonucleotide
  misc_feature (34)..(36): n is a, c, g, or t
tgcaggaccagagaattcgaatacatcgattaannntgcatcaggt

SEQ ID NO: 4073 - DNA, 46 bp, Artificial Sequence
  Synthesized adaptor oligonucleotide
  misc_feature (34)..(36): n is a, c, g, or t
tgcaggaccagagaattcgaatacacgccaaatnnntgcatcaggt

SEQ ID NO: 4074 - DNA, 46 bp, Artificial Sequence
  Synthesized adaptor oligonucleotide
  misc_feature (34)..(36): n is a, c, g, or t
tgcaggaccagagaattcgaatacacttgtaaannntgcatcaggt

SEQ ID NO: 4075 - DNA, 46 bp, Artificial Sequence
  Synthesized adaptor oligonucleotide
  misc_feature (34)..(36): n is a, c, g, or t
tgcaggaccagagaattcgaatacaaattagagnnntgcatcaggt

SEQ ID NO: 4076 - DNA, 46 bp, Artificial Sequence
  Synthesized adaptor oligonucleotide
  misc_feature (34)..(36): n is a, c, g, or t
tgcaggaccagagaattcgaatacatagcttggnnntgcatcaggt

SEQ ID NO: 4077 - DNA, 46 bp, Artificial Sequence
  Synthesized adaptor oligonucleotide
  misc_feature (34)..(36): n is a, c, g, or t
tgcaggaccagagaattcgaatacaataggagcnnntgcatcaggt

SEQ ID NO: 4078 - DNA, 46 bp, Artificial Sequence
  Synthesized adaptor oligonucleotide
  misc_feature (34)..(36): n is a, c, g, or t
tgcaggaccagagaattcgaatacattatactcnnntgcatcaggt

SEQ ID NO: 4079 - DNA, 46 bp, Artificial Sequence
  Synthesized adaptor oligonucleotide
  misc_feature (34)..(36): n is a, c, g, or t
tgcaggaccagagaattcgaatacattgttgccnnntgcatcaggt

SEQ ID NO: 4080 - DNA, 46 bp, Artificial Sequence
  Synthesized adaptor oligonucleotide
  misc_feature (34)..(36): n is a, c, g, or t
tgcaggaccagagaattcgaatacattccgagannntgcatcaggt

SEQ ID NO: 4081 - DNA, 46 bp, Artificial Sequence
  Synthesized adaptor oligonucleotide
  misc_feature (34)..(36): n is a, c, g, or t
tgcaggaccagagaattcgaatacaatcccatcnnntgcatcaggt

SEQ ID NO: 4082 - DNA, 46 bp, Artificial Sequence
  Synthesized adaptor oligonucleotide
  misc_feature (34)..(36): n is a, c, g, or t
tgcaggaccagagaattcgaatacatttgccacnnntgcatcaggt

SEQ ID NO: 4083 - DNA, 46 bp, Artificial Sequence
  Synthesized adaptor oligonucleotide
  misc_feature (34)..(36): n is a, c, g, or t
tgcaggaccagagaattcgaatacagtgagcggnnntgcatcaggt

SEQ ID NO: 4084 - DNA, 46 bp, Artificial Sequence
  Synthesized adaptor oligonucleotide
  misc_feature (34)..(36): n is a, c, g, or t
tgcaggaccagagaattcgaatacatcgcatctnnntgcatcaggt

SEQ ID NO: 4085 - DNA, 46 bp, Artificial Sequence
  Synthesized adaptor oligonucleotide
  misc_feature (34)..(36): n is a, c, g, or t
tgcaggaccagagaattcgaatacatctgcagannntgcatcaggt

SEQ ID NO: 4086 - DNA, 46 bp, Artificial Sequence
  Synthesized adaptor oligonucleotide
  misc_feature (34)..(36): n is a, c, g, or t
tgcaggaccagagaattcgaatacagcccaagcnnntgcatcaggt

SEQ ID NO: 4087 - DNA, 46 bp, Artificial Sequence
  Synthesized adaptor oligonucleotide
  misc_feature (34)..(36): n is a, c, g, or t
tgcaggaccagagaattcgaatacatttctcggnnntgcatcaggt

SEQ ID NO: 4088 - DNA, 46 bp, Artificial Sequence
  Synthesized adaptor oligonucleotide
  misc_feature (34)..(36): n is a, c, g, or t
tgcaggaccagagaattcgaatacaggcctacgnnntgcatcaggt

SEQ ID NO: 4089 - DNA, 46 bp, Artificial Sequence
  Synthesized adaptor oligonucleotide
  misc_feature (34)..(36): n is a, c, g, or t
tgcaggaccagagaattcgaatacaacgagacannnacgtatgcca

SEQ ID NO: 4090 - DNA, 46 bp, Artificial Sequence
  Synthesized adaptor oligonucleotide
  misc_feature (34)..(36): n is a, c, g, or t
tgcaggaccagagaattcgaatacacgctaatgnnnacgtatgcca

SEQ ID NO: 4091 - DNA, 46 bp, Artificial Sequence
  Synthesized adaptor oligonucleotide
  misc_feature (34)..(36): n is a, c, g, or t
tgcaggaccagagaattcgaatacatacgtcgannnacgtatgcca

SEQ ID NO: 4092 - DNA, 46 bp, Artificial Sequence
  Synthesized adaptor oligonucleotide
  misc_feature (34)..(36): n is a, c, g, or t
tgcaggaccagagaattcgaatacaattcgtggnnnacgtatgcca

SEQ ID NO: 4093 - DNA, 46 bp, Artificial Sequence
  Synthesized adaptor oligonucleotide
  misc_feature (34)..(36): n is a, c, g, or t
tgcaggaccagagaattcgaatacagtagaggtnnnacgtatgcca

SEQ ID NO: 4094 - DNA, 46 bp, Artificial Sequence
  Synthesized adaptor oligonucleotide
  misc_feature (34)..(36): n is a, c, g, or t
tgcaggaccagagaattcgaatacaggcggttcnnnacgtatgcca

SEQ ID NO: 4095 - DNA, 46 bp, Artificial Sequence
  Synthesized adaptor oligonucleotide
  misc_feature (34)..(36): n is a, c, g, or t
tgcaggaccagagaattcgaatacaataggctcnnnacgtatgcca

SEQ ID NO: 4096 - DNA, 46 bp, Artificial Sequence
  Synthesized adaptor oligonucleotide
  misc_feature (34)..(36): n is a, c, g, or t
tgcaggaccagagaattcgaatacatccaatttnnnacgtatgcca

SEQ ID NO: 4097 - DNA, 46 bp, Artificial Sequence
  Synthesized adaptor oligonucleotide
  misc_feature (34)..(36): n is a, c, g, or t
tgcaggaccagagaattcgaatacactgccgagnnnacgtatgcca

SEQ ID NO: 4098 - DNA, 46 bp, Artificial Sequence
  Synthesized adaptor oligonucleotide
  misc_feature (34)..(36): n is a, c, g, or t
tgcaggaccagagaattcgaatacactgtagtgnnnacgtatgcca

SEQ ID NO: 4099 - DNA, 46 bp, Artificial Sequence
  Synthesized adaptor oligonucleotide
  misc_feature (34)..(36): n is a, c, g, or t
tgcaggaccagagaattcgaatacaaacggtctnnnacgtatgcca

SEQ ID NO: 4100 - DNA, 46 bp, Artificial Sequence
  Synthesized adaptor oligonucleotide
  misc_feature (34)..(36): n is a, c, g, or t
tgcaggaccagagaattcgaatacacaggcgtcnnnacgtatgcca

SEQ ID NO: 4101 - DNA, 46 bp, Artificial Sequence
  Synthesized adaptor oligonucleotide
  misc_feature (34)..(36): n is a, c, g, or t
tgcaggaccagagaattcgaatacacttgcctannnacgtatgcca

SEQ ID NO: 4102 - DNA, 46 bp, Artificial Sequence
  Synthesized adaptor oligonucleotide
  misc_feature (34)..(36): n is a, c, g, or t
tgcaggaccagagaattcgaatacacttccgtannnacgtatgcca

SEQ ID NO: 4103 - DNA, 46 bp, Artificial Sequence
  Synthesized adaptor oligonucleotide
  misc_feature (34)..(36): n is a, c, g, or t
tgcaggaccagagaattcgaatacacagacgttnnnacgtatgcca

SEQ ID NO: 4104 - DNA, 46 bp, Artificial Sequence
  Synthesized adaptor oligonucleotide
  misc_feature (34)..(36): n is a, c, g, or t
tgcaggaccagagaattcgaatacaaggaacgtnnnacgtatgcca

SEQ ID NO: 4105 - DNA, 46 bp, Artificial Sequence
  Synthesized adaptor oligonucleotide
  misc_feature (34)..(36): n is a, c, g, or t
tgcaggaccagagaattcgaatacattgcgtagnnnacgtatgcca

SEQ ID NO: 4106 - DNA, 46 bp, Artificial Sequence
  Synthesized adaptor oligonucleotide
  misc_feature (34)..(36): n is a, c, g, or t
tgcaggaccagagaattcgaatacagcccgatgnnnacgtatgcca

SEQ ID NO: 4107 - DNA, 46 bp, Artificial Sequence
  Synthesized adaptor oligonucleotide
  misc_feature (34)..(36): n is a, c, g, or t
tgcaggaccagagaattcgaatacaaacgtctgnnnacgtatgcca

SEQ ID NO: 4108 - DNA, 46 bp, Artificial Sequence
  Synthesized adaptor oligonucleotide
  misc_feature (34)..(36): n is a, c, g, or t
tgcaggaccagagaattcgaatacactctacacnnnacgtatgcca

SEQ ID NO: 4109 - DNA, 46 bp, Artificial Sequence
  Synthesized adaptor oligonucleotide
  misc_feature (34)..(36): n is a, c, g, or t
tgcaggaccagagaattcgaatacaacgcggtcnnnacgtatgcca

SEQ ID NO: 4110 - DNA, 46 bp, Artificial Sequence
  Synthesized adaptor oligonucleotide
  misc_feature (34)..(36): n is a, c, g, or t
tgcaggaccagagaattcgaatacacatccagannnacgtatgcca

SEQ ID NO: 4111 - DNA, 46 bp, Artificial Sequence
  Synthesized adaptor oligonucleotide
  misc_feature (34)..(36): n is a, c, g, or t
tgcaggaccagagaattcgaatacaaagtcgagnnnacgtatgcca

SEQ ID NO: 4112 - DNA, 46 bp, Artificial Sequence
  Synthesized adaptor oligonucleotide
  misc_feature (34)..(36): n is a, c, g, or t
tgcaggaccagagaattcgaatacaggcagcctnnnacgtatgcca

SEQ ID NO: 4113 - DNA, 46 bp, Artificial Sequence
  Synthesized adaptor oligonucleotide
  misc_feature (34)..(36): n is a, c, g, or t
tgcaggaccagagaattcgaatacattatacagnnnacgtatgcca

SEQ ID NO: 4114 - DNA, 46 bp, Artificial Sequence
  Synthesized adaptor oligonucleotide
  misc_feature (34)..(36): n is a, c, g, or t
tgcaggaccagagaattcgaatacacccgtcgtnnnacgtatgcca

SEQ ID NO: 4115 - DNA, 46 bp, Artificial Sequence
  Synthesized adaptor oligonucleotide
  misc_feature (34)..(36): n is a, c, g, or t
tgcaggaccagagaattcgaatacataatttaannnacgtatgcca

SEQ ID NO: 4116 - DNA, 46 bp, Artificial Sequence
  Synthesized adaptor oligonucleotide
  misc_feature (34)..(36): n is a, c, g, or t
tgcaggaccagagaattcgaatacattcatcatnnnacgtatgcca

SEQ ID NO: 4117 - DNA, 46 bp, Artificial Sequence
  Synthesized adaptor oligonucleotide
  misc_feature (34)..(36): n is a, c, g, or t
tgcaggaccagagaattcgaatacacatgtatannnacgtatgcca

SEQ ID NO: 4118 - DNA, 46 bp, Artificial Sequence
  Synthesized adaptor oligonucleotide
  misc_feature (34)..(36): n is a, c, g, or t
tgcaggaccagagaattcgaatacagtagttatnnnacgtatgcca

SEQ ID NO: 4119 - DNA, 46 bp, Artificial Sequence
  Synthesized adaptor oligonucleotide
  misc_feature (34)..(36): n is a, c, g, or t
tgcaggaccagagaattcgaatacatgtatcggnnnacgtatgcca

SEQ ID NO: 4120 - DNA, 46 bp, Artificial Sequence
  Synthesized adaptor oligonucleotide
  misc_feature (34)..(36): n is a, c, g, or t
tgcaggaccagagaattcgaatacaagaggttgnnnacgtatgcca

SEQ ID NO: 4121 - DNA, 46 bp, Artificial Sequence
  Synthesized adaptor oligonucleotide
  misc_feature (34)..(36): n is a, c, g, or t
tgcaggaccagagaattcgaatacagcacaagannnacgtatgcca

SEQ ID NO: 4122 - DNA, 46 bp, Artificial Sequence
  Synthesized adaptor oligonucleotide
  misc_feature (34)..(36): n is a, c, g, or t
tgcaggaccagagaattcgaatacaaacccggcnnnacgtatgcca

SEQ ID NO: 4123 - DNA, 46 bp, Artificial Sequence
  Synthesized adaptor oligonucleotide
  misc_feature (34)..(36): n is a, c, g, or t
tgcaggaccagagaattcgaatacatgtggctannnacgtatgcca

SEQ ID NO: 4124 - DNA, 46 bp, Artificial Sequence
  Synthesized adaptor oligonucleotide
  misc_feature (34)..(36): n is a, c, g, or t
tgcaggaccagagaattcgaatacagtagctcannnacgtatgcca

SEQ ID NO: 4125 - DNA, 46 bp, Artificial Sequence
  Synthesized adaptor oligonucleotide
  misc_feature (34)..(36): n is a, c, g, or t
tgcaggaccagagaattcgaatacaggctggctnnnacgtatgcca

SEQ ID NO: 4126 - DNA, 46 bp, Artificial Sequence
  Synthesized adaptor oligonucleotide
  misc_feature (34)..(36): n is a, c, g, or t
tgcaggaccagagaattcgaatacatacagctgnnnacgtatgcca

SEQ ID NO: 4127 - DNA, 46 bp, Artificial Sequence
  Synthesized adaptor oligonucleotide
  misc_feature (34)..(36): n is a, c, g, or t
tgcaggaccagagaattcgaatacacttgtgtcnnnacgtatgcca

SEQ ID NO: 4128 - DNA, 46 bp, Artificial Sequence
  Synthesized adaptor oligonucleotide
  misc_feature (34)..(36): n is a, c, g, or t
tgcaggaccagagaattcgaatacaagcatcgtnnnacgtatgcca

SEQ ID NO: 4129 - DNA, 46 bp, Artificial Sequence
  Synthesized adaptor oligonucleotide
  misc_feature (34)..(36): n is a, c, g, or t
tgcaggaccagagaattcgaatacaaataaagcnnnacgtatgcca

SEQ ID NO: 4130 - DNA, 46 bp, Artificial Sequence
  Synthesized adaptor oligonucleotide
  misc_feature (34)..(36): n is a, c, g, or t
tgcaggaccagagaattcgaatacactatcggannnacgtatgcca

SEQ ID NO: 4131 - DNA, 46 bp, Artificial Sequence
  Synthesized adaptor oligonucleotide
  misc_feature (34)..(36): n is a, c, g, or t
tgcaggaccagagaattcgaatacaccgcccgcnnnacgtatgcca

SEQ ID NO: 4132 - DNA, 46 bp, Artificial Sequence
  Synthesized adaptor oligonucleotide
  misc_feature (34)..(36): n is a, c, g, or t
tgcaggaccagagaattcgaatacatcgtttcgnnnacgtatgcca

SEQ ID NO: 4133 - DNA, 46 bp, Artificial Sequence
  Synthesized adaptor oligonucleotide
  misc_feature (34)..(36): n is a, c, g, or t
tgcaggaccagagaattcgaatacacctagcaannnacgtatgcca

SEQ ID NO: 4134 - DNA, 46 bp, Artificial Sequence
  Synthesized adaptor oligonucleotide
  misc_feature (34)..(36): n is a, c, g, or t
tgcaggaccagagaattcgaatacatgaacattnnnacgtatgcca

SEQ ID NO: 4135 - DNA, 46 bp, Artificial Sequence
  Synthesized adaptor oligonucleotide
  misc_feature (34)..(36): n is a, c, g, or t
tgcaggaccagagaattcgaatacatgtaacatnnnacgtatgcca

SEQ ID NO: 4136 - DNA, 46 bp, Artificial Sequence
  Synthesized adaptor oligonucleotide
  misc_feature (34)..(36): n is a, c, g, or t
tgcaggaccagagaattcgaatacagtcggaaannnacgtatgcca

SEQ ID NO: 4137 - DNA, 46 bp, Artificial Sequence
  Synthesized adaptor oligonucleotide
  misc_feature (34)..(36): n is a, c, g, or t
tgcaggaccagagaattcgaatacagttggccgnnnacgtatgcca

SEQ ID NO: 4138 - DNA, 46 bp, Artificial Sequence
  Synthesized adaptor oligonucleotide
  misc_feature (34)..(36): n is a, c, g, or t
tgcaggaccagagaattcgaatacagcgatagannnacgtatgcca

SEQ ID NO: 4139 - DNA, 46 bp, Artificial Sequence
  Synthesized adaptor oligonucleotide
  misc_feature (34)..(36): n is a, c, g, or t
tgcaggaccagagaattcgaatacattaacgtannnacgtatgcca

SEQ ID NO: 4140 - DNA, 46 bp, Artificial Sequence
  Synthesized adaptor oligonucleotide
  misc_feature (34)..(36): n is a, c, g, or t
tgcaggaccagagaattcgaatacaccttatatnnnacgtatgcca

SEQ ID NO: 4141 - DNA, 46 bp, Artificial Sequence
  Synthesized adaptor oligonucleotide
  misc_feature (34)..(36): n is a, c, g, or t
tgcaggaccagagaattcgaatacaaaacagatnnnacgtatgcca

SEQ ID NO: 4142 - DNA, 46 bp, Artificial Sequence
  Synthesized adaptor oligonucleotide
  misc_feature (34)..(36): n is a, c, g, or t
tgcaggaccagagaattcgaatacatacccatcnnnacgtatgcca

SEQ ID NO: 4143 - DNA, 46 bp, Artificial Sequence
  Synthesized adaptor oligonucleotide
  misc_feature (34)..(36): n is a, c, g, or t
tgcaggaccagagaattcgaatacaaaaagagannnacgtatgcca

SEQ ID NO: 4144 - DNA, 46 bp, Artificial Sequence
  Synthesized adaptor oligonucleotide
  misc_feature (34)..(36): n is a, c, g, or t
tgcaggaccagagaattcgaatacacgttcgaannnacgtatgcca

SEQ ID NO: 4145 - DNA, 46 bp, Artificial Sequence
  Synthesized adaptor oligonucleotide
  misc_feature (34)..(36): n is a, c, g, or t
tgcaggaccagagaattcgaatacaatggatccnnnacgtatgcca

SEQ ID NO: 4146 - DNA, 46 bp, Artificial Sequence
  Synthesized adaptor oligonucleotide
  misc_feature (34)..(36): n is a, c, g, or t
tgcaggaccagagaattcgaatacagctcgatannnacgtatgcca

SEQ ID NO: 4147 - DNA, 46 bp, Artificial Sequence
  Synthesized adaptor oligonucleotide
  misc_feature (34)..(36): n is a, c, g, or t
tgcaggaccagagaattcgaatacatgtaaccgnnnacgtatgcca

SEQ ID NO: 4148 - DNA, 46 bp, Artificial Sequence
  Synthesized adaptor oligonucleotide
  misc_feature (34)..(36): n is a, c, g, or t
tgcaggaccagagaattcgaatacaatctacttnnnacgtatgcca

SEQ ID NO: 4149 - DNA, 46 bp, Artificial Sequence
  Synthesized adaptor oligonucleotide
  misc_feature (34)..(36): n is a, c, g, or t
tgcaggaccagagaattcgaatacagatcgtacnnnctagcgttac

SEQ ID NO: 4150 - DNA, 46 bp, Artificial Sequence
  Synthesized adaptor oligonucleotide
  misc_feature (34)..(36): n is a, c, g, or t
tgcaggaccagagaattcgaatacatgaacgtcnnnctagcgttac

SEQ ID NO: 4151 - DNA, 46 bp, Artificial Sequence
  Synthesized adaptor oligonucleotide
  misc_feature (34)..(36): n is a, c, g, or t
tgcaggaccagagaattcgaatacatccaactcnnnctagcgttac

SEQ ID NO: 4152 - DNA, 46 bp, Artificial Sequence
  Synthesized adaptor oligonucleotide
  misc_feature (34)..(36): n is a, c, g, or t
tgcaggaccagagaattcgaatacagcggaggtnnnctagcgttac

SEQ ID NO: 4153 - DNA, 46 bp, Artificial Sequence
  Synthesized adaptor oligonucleotide
  misc_feature (34)..(36): n is a, c, g, or t
tgcaggaccagagaattcgaatacatgcccattnnnctagcgttac

SEQ ID NO: 4154 - DNA, 46 bp, Artificial Sequence
  Synthesized adaptor oligonucleotide
  misc_feature (34)..(36): n is a, c, g, or t
tgcaggaccagagaattcgaatacaacgatcacnnnctagcgttac

SEQ ID NO: 4155 - DNA, 46 bp, Artificial Sequence
  Synthesized adaptor oligonucleotide
  misc_feature (34)..(36): n is a, c, g, or t
tgcaggaccagagaattcgaatacataaggtaannnctagcgttac

SEQ ID NO: 4156 - DNA, 46 bp, Artificial Sequence
  Synthesized adaptor oligonucleotide
  misc_feature (34)..(36): n is a, c, g, or t
tgcaggaccagagaattcgaatacaacctacgannnctagcgttac

SEQ ID NO: 4157 - DNA, 46 bp, Artificial Sequence
  Synthesized adaptor oligonucleotide
  misc_feature (34)..(36): n is a, c, g, or t
tgcaggaccagagaattcgaatacacacaccaannnctagcgttac

SEQ ID NO: 4158 - DNA, 46 bp, Artificial Sequence
  Synthesized adaptor oligonucleotide
  misc_feature (34)..(36): n is a, c, g, or t
tgcaggaccagagaattcgaatacatggtcggcnnnctagcgttac

SEQ ID NO: 4159 - DNA, 46 bp, Artificial Sequence
  Synthesized adaptor oligonucleotide
  misc_feature (34)..(36): n is a, c, g, or t
tgcaggaccagagaattcgaatacattatctgtnnnctagcgttac

SEQ ID NO: 4160 - DNA, 46 bp, Artificial Sequence
  Synthesized adaptor oligonucleotide
  misc_feature (34)..(36): n is a, c, g, or t
tgcaggaccagagaattcgaatacatcgagccgnnnctagcgttac

SEQ ID NO: 4161 - DNA, 46 bp, Artificial Sequence
  Synthesized adaptor oligonucleotide
  misc_feature (34)..(36): n is a, c, g, or t
tgcaggaccagagaattcgaatacataccgatgnnnctagcgttac

SEQ ID NO: 4162 - DNA, 46 bp, Artificial Sequence
  Synthesized adaptor oligonucleotide
  misc_feature (34)..(36): n is a, c, g, or t
tgcaggaccagagaattcgaatacagaacggatnnnctagcgttac

SEQ ID NO: 4163 - DNA, 46 bp, Artificial Sequence
  Synthesized adaptor oligonucleotide
  misc_feature (34)..(36): n is a, c, g, or t
tgcaggaccagagaattcgaatacattgttctannnctagcgttac

SEQ ID NO: 4164 - DNA, 46 bp, Artificial Sequence
  Synthesized adaptor oligonucleotide
  misc_feature (34)..(36): n is a, c, g, or t
tgcaggaccagagaattcgaatacaggtcgtcgnnnctagcgttac

SEQ ID NO: 4165 - DNA, 46 bp, Artificial Sequence
  Synthesized adaptor oligonucleotide
  misc_feature (34)..(36): n is a, c, g, or t
tgcaggaccagagaattcgaatacaatgcttccnnnctagcgttac

SEQ ID NO: 4166 - DNA, 46 bp, Artificial Sequence
  Synthesized adaptor oligonucleotide
  misc_feature (34)..(36): n is a, c, g, or t
tgcaggaccagagaattcgaatacatcaggactnnnctagcgttac

SEQ ID NO: 4167 - DNA, 46 bp, Artificial Sequence
  Synthesized adaptor oligonucleotide
  misc_feature (34)..(36): n is a, c, g, or t
tgcaggaccagagaattcgaatacaaagacatannnctagcgttac

SEQ ID NO: 4168 - DNA, 46 bp, Artificial Sequence
  Synthesized adaptor oligonucleotide
  misc_feature (34)..(36): n is a, c, g, or t
tgcaggaccagagaattcgaatacaccatcgttnnnctagcgttac

SEQ ID NO: 4169 - DNA, 46 bp, Artificial Sequence
  Synthesized adaptor oligonucleotide
  misc_feature (34)..(36): n is a, c, g, or t
tgcaggaccagagaattcgaatacataacaccgnnnctagcgttac

SEQ ID NO: 4170 - DNA, 46 bp, Artificial Sequence
  Synthesized adaptor oligonucleotide
  misc_feature (34)..(36): n is a, c, g, or t
tgcaggaccagagaattcgaatacacctcctccnnnctagcgttac

SEQ ID NO: 4171 - DNA, 46 bp, Artificial Sequence
  Synthesized adaptor oligonucleotide
  misc_feature (34)..(36): n is a, c, g, or t
tgcaggaccagagaattcgaatacatcggactannnctagcgttac

SEQ ID NO: 4172 - DNA, 46 bp, Artificial Sequence
  Synthesized adaptor oligonucleotide
  misc_feature (34)..(36): n is a, c, g, or t
tgcaggaccagagaattcgaatacaggcaaacannnctagcgttac

SEQ ID NO: 4173 - DNA, 46 bp, Artificial Sequence
  Synthesized adaptor oligonucleotide
  misc_feature (34)..(36): n is a, c, g, or t
tgcaggaccagagaattcgaatacaggaaacacnnnctagcgttac

SEQ ID NO: 4174 - DNA, 46 bp, Artificial Sequence
  Synthesized adaptor oligonucleotide
  misc_feature (34)..(36): n is a, c, g, or t
tgcaggaccagagaattcgaatacatacactccnnnctagcgttac

SEQ ID NO: 4175 - DNA, 46 bp, Artificial Sequence
  Synthesized adaptor oligonucleotide
  misc_feature (34)..(36): n is a, c, g, or t
tgcaggaccagagaattcgaatacacggacctgnnnctagcgttac

SEQ ID NO: 4176 - DNA, 46 bp, Artificial Sequence
  Synthesized adaptor oligonucleotide
  misc_feature (34)..(36): n is a, c, g, or t
tgcaggaccagagaattcgaatacaatcctgagnnnctagcgttac

SEQ ID NO: 4177 - DNA, 46 bp, Artificial Sequence
  Synthesized adaptor oligonucleotide
  misc_feature (34)..(36): n is a, c, g, or t
tgcaggaccagagaattcgaatacacccgtctgnnnctagcgttac

SEQ ID NO: 4178 - DNA, 46 bp, Artificial Sequence
  Synthesized adaptor oligonucleotide
  misc_feature (34)..(36): n is a, c, g, or t
tgcaggaccagagaattcgaatacaggctcaatnnnctagcgttac

SEQ ID NO: 4179 - DNA, 46 bp, Artificial Sequence
  Synthesized adaptor oligonucleotide
  misc_feature (34)..(36): n is a, c, g, or t
tgcaggaccagagaattcgaatacagtgcttgannnctagcgttac

SEQ ID NO: 4180 - DNA, 46 bp, Artificial Sequence
  Synthesized adaptor oligonucleotide
  misc_feature (34)..(36): n is a, c, g, or t
tgcaggaccagagaattcgaatacaattaactgnnnctagcgttac

SEQ ID NO: 4181 - DNA, 46 bp, Artificial Sequence
  Synthesized adaptor oligonucleotide
  misc_feature (34)..(36): n is a, c, g, or t
tgcaggaccagagaattcgaatacatccagatgnnnctagcgttac

SEQ ID NO: 4182 - DNA, 46 bp, Artificial Sequence
  Synthesized adaptor oligonucleotide
  misc_feature (34)..(36): n is a, c, g, or t
tgcaggaccagagaattcgaatacaccgcgcggnnnctagcgttac

SEQ ID NO: 4183 - DNA, 46 bp, Artificial Sequence
  Synthesized adaptor oligonucleotide
  misc_feature (34)..(36): n is a, c, g, or t
tgcaggaccagagaattcgaatacaccataagcnnnctagcgttac

SEQ ID NO: 4184 - DNA, 46 bp, Artificial Sequence
  Synthesized adaptor oligonucleotide
  misc_feature (34)..(36): n is a, c, g, or t
tgcaggaccagagaattcgaatacaggttggttnnnctagcgttac

SEQ ID NO: 4185 - DNA, 46 bp, Artificial Sequence
  Synthesized adaptor oligonucleotide
  misc_feature (34)..(36): n is a, c, g, or t
tgcaggaccagagaattcgaatacaggcagatannnctagcgttac

SEQ ID NO: 4186 - DNA, 46 bp, Artificial Sequence
  Synthesized adaptor oligonucleotide
  misc_feature (34)..(36): n is a, c, g, or t
tgcaggaccagagaattcgaatacaatgcaaccnnnctagcgttac

SEQ ID NO: 4187 - DNA, 46 bp, Artificial Sequence
  Synthesized adaptor oligonucleotide
  misc_feature (34)..(36): n is a, c, g, or t
tgcaggaccagagaattcgaatacagcgcgccgnnnctagcgttac

SEQ ID NO: 4188 - DNA, 46 bp, Artificial Sequence
  Synthesized adaptor oligonucleotide
  misc_feature (34)..(36): n is a, c, g, or t
tgcaggaccagagaattcgaatacacaaagtggnnnctagcgttac

SEQ ID NO: 4189 - DNA, 46 bp, Artificial Sequence
  Synthesized adaptor oligonucleotide
  misc_feature (34)..(36): n is a, c, g, or t
tgcaggaccagagaattcgaatacataaaagcannnctagcgttac

SEQ ID NO: 4190 - DNA, 46 bp, Artificial Sequence
  Synthesized adaptor oligonucleotide
  misc_feature (34)..(36): n is a, c, g, or t
tgcaggaccagagaattcgaatacaatctgtggnnnctagcgttac

SEQ ID NO: 4191 - DNA, 46 bp, Artificial Sequence
  Synthesized adaptor oligonucleotide
  misc_feature (34)..(36): n is a, c, g, or t
tgcaggaccagagaattcgaatacacgtatatannnctagcgttac

SEQ ID NO: 4192 - DNA, 46 bp, Artificial Sequence
  Synthesized adaptor oligonucleotide
  misc_feature (34)..(36): n is a, c, g, or t
tgcaggaccagagaattcgaatacaggtattgcnnnctagcgttac

SEQ ID NO: 4193 - DNA, 46 bp, Artificial Sequence
  Synthesized adaptor oligonucleotide
  misc_feature (34)..(36): n is a, c, g, or t
tgcaggaccagagaattcgaatacatacaaactnnnctagcgttac

SEQ ID NO: 4194 - DNA, 46 bp, Artificial Sequence
  Synthesized adaptor oligonucleotide
  misc_feature (34)..(36): n is a, c, g, or t
tgcaggaccagagaattcgaatacactcttaatnnnctagcgttac

SEQ ID NO: 4195 - DNA, 46 bp, Artificial Sequence
  Synthesized adaptor oligonucleotide
  misc_feature (34)..(36): n is a, c, g, or t
tgcaggaccagagaattcgaatacaggtctgatnnnctagcgttac

SEQ ID NO: 4196 - DNA, 46 bp, Artificial Sequence
  Synthesized adaptor oligonucleotide
  misc_feature (34)..(36): n is a, c, g, or t
tgcaggaccagagaattcgaatacatcaggaagnnnctagcgttac

SEQ ID NO: 4197 - DNA, 46 bp, Artificial Sequence
  Synthesized adaptor oligonucleotide
  misc_feature (34)..(36): n is a, c, g, or t
tgcaggaccagagaattcgaatacacacgctttnnnctagcgttac

SEQ ID NO: 4198 - DNA, 46 bp, Artificial Sequence
  Synthesized adaptor oligonucleotide
  misc_feature (34)..(36): n is a, c, g, or t
tgcaggaccagagaattcgaatacaggcggcaannnctagcgttac

SEQ ID NO: 4199 - DNA, 46 bp, Artificial Sequence
  Synthesized adaptor oligonucleotide
  misc_feature (34)..(36): n is a, c, g, or t
tgcaggaccagagaattcgaatacagaagttggnnnctagcgttac

SEQ ID NO: 4200 - DNA, 46 bp, Artificial Sequence
  Synthesized adaptor oligonucleotide
  misc_feature (34)..(36): n is a, c, g, or t
tgcaggaccagagaattcgaatacagcaggtggnnnctagcgttac

SEQ ID NO: 4201 - DNA, 46 bp, Artificial Sequence
  Synthesized adaptor oligonucleotide
  misc_feature (34)..(36): n is a, c, g, or t
tgcaggaccagagaattcgaatacatgtaatcannnctagcgttac

SEQ ID NO: 4202 - DNA, 46 bp, Artificial Sequence
  Synthesized adaptor oligonucleotide
  misc_feature (34)..(36): n is a, c, g, or t
tgcaggaccagagaattcgaatacagtcaaccannnctagcgttac

SEQ ID NO: 4203 - DNA, 46 bp, Artificial Sequence
  Synthesized adaptor oligonucleotide
  misc_feature (34)..(36): n is a, c, g, or t
tgcaggaccagagaattcgaatacagagcaacannnctagcgttac

SEQ ID NO: 4204 - DNA, 46 bp, Artificial Sequence
  Synthesized adaptor oligonucleotide
  misc_feature (34)..(36): n is a, c, g, or t
tgcaggaccagagaattcgaatacaaccgtcggnnnctagcgttac

SEQ ID NO: 4205 - DNA, 46 bp, Artificial Sequence
  Synthesized adaptor oligonucleotide
  misc_feature (34)..(36): n is a, c, g, or t
tgcaggaccagagaattcgaatacataggcgccnnnctagcgttac

SEQ ID NO: 4206 - DNA, 46 bp, Artificial Sequence
  Synthesized adaptor oligonucleotide
  misc_feature (34)..(36): n is a, c, g, or t
tgcaggaccagagaattcgaatacagaagcagtnnnctagcgttac

SEQ ID NO: 4207 - DNA, 46 bp, Artificial Sequence
  Synthesized adaptor oligonucleotide
  misc_feature (34)..(36): n is a, c, g, or t
tgcaggaccagagaattcgaatacattggtatannnctagcgttac

SEQ ID NO: 4208 - DNA, 46 bp, Artificial Sequence
  Synthesized adaptor oligonucleotide
  misc_feature (34)..(36): n is a, c, g, or t
tgcaggaccagagaattcgaatacagaagtgtgnnnctagcgttac

SEQ ID NO: 4209 - DNA, 46 bp, Artificial Sequence
  Synthesized adaptor oligonucleotide
  misc_feature (34)..(36): n is a, c, g, or t
tgcaggaccagagaattcgaatacactgctttgnnngatcgacatg

SEQ ID NO: 4210 - DNA, 46 bp, Artificial Sequence
  Synthesized adaptor oligonucleotide
  misc_feature (34)..(36): n is a, c, g, or t
tgcaggaccagagaattcgaatacagttccgccnnngatcgacatg

SEQ ID NO: 4211 - DNA, 46 bp, Artificial Sequence
  Synthesized adaptor oligonucleotide
  misc_feature (34)..(36): n is a, c, g, or t
tgcaggaccagagaattcgaatacacgactatgnnngatcgacatg

SEQ ID NO: 4212 - DNA, 46 bp, Artificial Sequence
  Synthesized adaptor oligonucleotide
  misc_feature (34)..(36): n is a, c, g, or t
tgcaggaccagagaattcgaatacactgtagcannngatcgacatg

SEQ ID NO: 4213 - DNA, 46 bp, Artificial Sequence
  Synthesized adaptor oligonucleotide
  misc_feature (34)..(36): n is a, c, g, or t
tgcaggaccagagaattcgaatacacgcggtcannngatcgacatg

SEQ ID NO: 4214 - DNA, 46 bp, Artificial Sequence
  Synthesized adaptor oligonucleotide
  misc_feature (34)..(36): n is a, c, g, or t
tgcaggaccagagaattcgaatacatccatgagnnngatcgacatg

SEQ ID NO: 4215 - DNA, 46 bp, Artificial Sequence
  Synthesized adaptor oligonucleotide
  misc_feature (34)..(36): n is a, c, g, or t
tgcaggaccagagaattcgaatacaggctccctnnngatcgacatg

SEQ ID NO: 4216 - DNA, 46 bp, Artificial Sequence
  Synthesized adaptor oligonucleotide
  misc_feature (34)..(36): n is a, c, g, or t
tgcaggaccagagaattcgaatacaagcctaacnnngatcgacatg

SEQ ID NO: 4217 - DNA, 46 bp, Artificial Sequence
  Synthesized adaptor oligonucleotide
  misc_feature (34)..(36): n is a, c, g, or t
tgcaggaccagagaattcgaatacacgaggaatnnngatcgacatg

SEQ ID NO: 4218 - DNA, 46 bp, Artificial Sequence
  Synthesized adaptor oligonucleotide
  misc_feature (34)..(36): n is a, c, g, or t
tgcaggaccagagaattcgaatacacccgagcannngatcgacatg

SEQ ID NO: 4219 - DNA, 46 bp, Artificial Sequence
  Synthesized adaptor oligonucleotide
  misc_feature (34)..(36): n is a, c, g, or t
tgcaggaccagagaattcgaatacatacaatacnnngatcgacatg

SEQ ID NO: 4220 - DNA, 46 bp, Artificial Sequence
  Synthesized adaptor oligonucleotide
  misc_feature (34)..(36): n is a, c, g, or t
tgcaggaccagagaattcgaatacataacatgtnnngatcgacatg

SEQ ID NO: 4221 - DNA, 46 bp, Artificial Sequence
  Synthesized adaptor oligonucleotide
  misc_feature (34)..(36): n is a, c, g, or t
tgcaggaccagagaattcgaatacagttgcggcnnngatcgacatg

SEQ ID NO: 4222 - DNA, 46 bp, Artificial Sequence
  Synthesized adaptor oligonucleotide
  misc_feature (34)..(36): n is a, c, g, or t
tgcaggaccagagaattcgaatacaatctgcagnnngatcgacatg

SEQ ID NO: 4223 - DNA, 46 bp, Artificial Sequence
  Synthesized adaptor oligonucleotide
  misc_feature (34)..(36): n is a, c, g, or t
tgcaggaccagagaattcgaatacaggttagtcnnngatcgacatg

SEQ ID NO: 4224 - DNA, 46 bp, Artificial Sequence
  Synthesized adaptor oligonucleotide
  misc_feature (34)..(36): n is a, c, g, or t
tgcaggaccagagaattcgaatacacttaagatnnngatcgacatg

SEQ ID NO: 4225 - DNA, 46 bp, Artificial Sequence
  Synthesized adaptor oligonucleotide
  misc_feature (34)..(36): n is a, c, g, or t
tgcaggaccagagaattcgaatacactcctacannngatcgacatg

SEQ ID NO: 4226 - DNA, 46 bp, Artificial Sequence
  Synthesized adaptor oligonucleotide
  misc_feature (34)..(36): n is a, c, g, or t
tgcaggaccagagaattcgaatacagctcagtannngatcgacatg

SEQ ID NO: 4227 - DNA, 46 bp, Artificial Sequence
  Synthesized adaptor oligonucleotide
  misc_feature (34)..(36): n is a, c, g, or t
tgcaggaccagagaattcgaatacaggtactacnnngatcgacatg

SEQ ID NO: 4228 - DNA, 46 bp, Artificial Sequence
  Synthesized adaptor oligonucleotide
  misc_feature (34)..(36): n is a, c, g, or t
tgcaggaccagagaattcgaatacatagtatgtnnngatcgacatg

SEQ ID NO: 4229 - DNA, 46 bp, Artificial Sequence
  Synthesized adaptor oligonucleotide
  misc_feature (34)..(36): n is a, c, g, or t
tgcaggaccagagaattcgaatacaaagcatccnnngatcgacatg

SEQ ID NO: 4230 - DNA, 46 bp, Artificial Sequence
  Synthesized adaptor oligonucleotide
  misc_feature (34)..(36): n is a, c, g, or t
tgcaggaccagagaattcgaatacaactaaaagnnngatcgacatg

SEQ ID NO: 4231 - DNA, 46 bp, Artificial Sequence
  Synthesized adaptor oligonucleotide
  misc_feature (34)..(36): n is a, c, g, or t
tgcaggaccagagaattcgaatacaactttaagnnngatcgacatg

SEQ ID NO: 4232 - DNA, 46 bp, Artificial Sequence
  Synthesized adaptor oligonucleotide
  misc_feature (34)..(36): n is a, c, g, or t
tgcaggaccagagaattcgaatacaacgaataannngatcgacatg

SEQ ID NO: 4233 - DNA, 46 bp, Artificial Sequence
  Synthesized adaptor oligonucleotide
  misc_feature (34)..(36): n is a, c, g, or t
tgcaggaccagagaattcgaatacatagcgtcannngatcgacatg

SEQ ID NO: 4234 - DNA, 46 bp, Artificial Sequence
  Synthesized adaptor oligonucleotide
  misc_feature (34)..(36): n is a, c, g, or t
tgcaggaccagagaattcgaatacaatcatcccnnngatcgacatg

SEQ ID NO: 4235 - DNA, 46 bp, Artificial Sequence
  Synthesized adaptor oligonucleotide
  misc_feature (34)..(36): n is a, c, g, or t
tgcaggaccagagaattcgaatacaaaaacaacnnngatcgacatg

SEQ ID NO: 4236 - DNA, 46 bp, Artificial Sequence
  Synthesized adaptor oligonucleotide
  misc_feature (34)..(36): n is a, c, g, or t
tgcaggaccagagaattcgaatacactatcaggnnngatcgacatg

SEQ ID NO: 4237 - DNA, 46 bp, Artificial Sequence
  Synthesized adaptor oligonucleotide
  misc_feature (34)..(36): n is a, c, g, or t
tgcaggaccagagaattcgaatacatactgtccnnngatcgacatg

SEQ ID NO: 4238 - DNA, 46 bp, Artificial Sequence
  Synthesized adaptor oligonucleotide
  misc_feature (34)..(36): n is a, c, g, or t
tgcaggaccagagaattcgaatacaaggacacannngatcgacatg

SEQ ID NO: 4239 - DNA, 46 bp, Artificial Sequence
  Synthesized adaptor oligonucleotide
  misc_feature (34)..(36): n is a, c, g, or t
tgcaggaccagagaattcgaatacagtgacgttnnngatcgacatg

SEQ ID NO: 4240 - DNA, 46 bp, Artificial Sequence
  Synthesized adaptor oligonucleotide
  misc_feature (34)..(36): n is a, c, g, or t
tgcaggaccagagaattcgaatacacttgtaccnnngatcgacatg

SEQ ID NO: 4241 - DNA, 46 bp, Artificial Sequence
  Synthesized adaptor oligonucleotide
  misc_feature (34)..(36): n is a, c, g, or t
tgcaggaccagagaattcgaatacaggatgcggnnngatcgacatg

SEQ ID NO: 4242 - DNA, 46 bp, Artificial Sequence
  Synthesized adaptor oligonucleotide
  misc_feature (34)..(36): n is a, c, g, or t
tgcaggaccagagaattcgaatacactgattggnnngatcgacatg

SEQ ID NO: 4243 - DNA, 46 bp, Artificial Sequence
  Synthesized adaptor oligonucleotide
  misc_feature (34)..(36): n is a, c, g, or t
tgcaggaccagagaattcgaatacagcaactcannngatcgacatg

SEQ ID NO: 4244 - DNA, 46 bp, Artificial Sequence
  Synthesized adaptor oligonucleotide
  misc_feature (34)..(36): n is a, c, g, or t
tgcaggaccagagaattcgaatacatacctcacnnngatcgacatg

SEQ ID NO: 4245 - DNA, 46 bp, Artificial Sequence
  Synthesized adaptor oligonucleotide
  misc_feature (34)..(36): n is a, c, g, or t
tgcaggaccagagaattcgaatacatgcaccccnnngatcgacatg

SEQ ID NO: 4246 - DNA, 46 bp, Artificial Sequence
  Synthesized adaptor oligonucleotide
  misc_feature (34)..(36): n is a, c, g, or t
tgcaggaccagagaattcgaatacagttcctacnnngatcgacatg

SEQ ID NO: 4247 - DNA, 46 bp, Artificial Sequence
  Synthesized adaptor oligonucleotide
  misc_feature (34)..(36): n is a, c, g, or t
tgcaggaccagagaattcgaatacatactgtttnnngatcgacatg

SEQ ID NO: 4248 - DNA, 46 bp, Artificial Sequence
  Synthesized adaptor oligonucleotide
  misc_feature (34)..(36): n is a, c, g, or t
tgcaggaccagagaattcgaatacacttcatatnnngatcgacatg

SEQ ID NO: 4249 - DNA, 46 bp, Artificial Sequence
  Synthesized adaptor oligonucleotide
  misc_feature (34)..(36): n is a, c, g, or t
tgcaggaccagagaattcgaatacatctgctgtnnngatcgacatg

SEQ ID NO: 4250 - DNA, 46 bp, Artificial Sequence
  Synthesized adaptor oligonucleotide
  misc_feature (34)..(36): n is a, c, g, or t
tgcaggaccagagaattcgaatacatggtattannngatcgacatg

SEQ ID NO: 4251 - DNA, 46 bp, Artificial Sequence
  Synthesized adaptor oligonucleotide
  misc_feature (34)..(36): n is a, c, g, or t
tgcaggaccagagaattcgaatacaagaatgtannngatcgacatg

SEQ ID NO: 4252 - DNA, 46 bp, Artificial Sequence
  Synthesized adaptor oligonucleotide
  misc_feature (34)..(36): n is a, c, g, or t
tgcaggaccagagaattcgaatacaggcgagcannngatcgacatg

SEQ ID NO: 4253 - DNA, 46 bp, Artificial Sequence
  Synthesized adaptor oligonucleotide
  misc_feature (34)..(36): n is a, c, g, or t
tgcaggaccagagaattcgaatacagccacaatnnngatcgacatg

SEQ ID NO: 4254 - DNA, 46 bp, Artificial Sequence
  Synthesized adaptor oligonucleotide
  misc_feature (34)..(36): n is a, c, g, or t
tgcaggaccagagaattcgaatacatattctcannngatcgacatg

SEQ ID NO: 4255 - DNA, 46 bp, Artificial Sequence
  Synthesized adaptor oligonucleotide
  misc_feature (34)..(36): n is a, c, g, or t
tgcaggaccagagaattcgaatacaaagacctcnnngatcgacatg

SEQ ID NO: 4256 - DNA, 46 bp, Artificial Sequence
  Synthesized adaptor oligonucleotide
  misc_feature (34)..(36): n is a, c, g, or t
tgcaggaccagagaattcgaatacacacataatnnngatcgacatg

SEQ ID NO: 4257 - DNA, 46 bp, Artificial Sequence
  Synthesized adaptor oligonucleotide
  misc_feature (34)..(36): n is a, c, g, or t
tgcaggaccagagaattcgaatacaaccctgaannngatcgacatg

SEQ ID NO: 4258 - DNA, 46 bp, Artificial Sequence
  Synthesized adaptor oligonucleotide
  misc_feature (34)..(36): n is a, c, g, or t
tgcaggaccagagaattcgaatacagtagacctnnngatcgacatg

SEQ ID NO: 4259 - DNA, 46 bp, Artificial Sequence
  Synthesized adaptor oligonucleotide
  misc_feature (34)..(36): n is a, c, g, or t
tgcaggaccagagaattcgaatacaccctaccgnnngatcgacatg

SEQ ID NO: 4260 - DNA, 46 bp, Artificial Sequence
  Synthesized adaptor oligonucleotide
  misc_feature (34)..(36): n is a, c, g, or t
tgcaggaccagagaattcgaatacatatcccacnnngatcgacatg

SEQ ID NO: 4261 - DNA, 46 bp, Artificial Sequence
  Synthesized adaptor oligonucleotide
  misc_feature (34)..(36): n is a, c, g, or t
tgcaggaccagagaattcgaatacaagtcattannngatcgacatg

SEQ ID NO: 4262 - DNA, 46 bp, Artificial Sequence
  Synthesized adaptor oligonucleotide
  misc_feature (34)..(36): n is a, c, g, or t
tgcaggaccagagaattcgaatacaggaacaacnnngatcgacatg

SEQ ID NO: 4263 - DNA, 46 bp, Artificial Sequence
  Synthesized adaptor oligonucleotide
  misc_feature (34)..(36): n is a, c, g, or t
tgcaggaccagagaattcgaatacaatctctgcnnngatcgacatg

SEQ ID NO: 4264 - DNA, 46 bp, Artificial Sequence
  Synthesized adaptor oligonucleotide
  misc_feature (34)..(36): n is a, c, g, or t
tgcaggaccagagaattcgaatacactgtacctnnngatcgacatg

SEQ ID NO: 4265 - DNA, 46 bp, Artificial Sequence
  Synthesized adaptor oligonucleotide
  misc_feature (34)..(36): n is a, c, g, or t
tgcaggaccagagaattcgaatacagatccagtnnngatcgacatg

SEQ ID NO: 4266 - DNA, 46 bp, Artificial Sequence
  Synthesized adaptor oligonucleotide
  misc_feature (34)..(36): n is a, c, g, or t
tgcaggaccagagaattcgaatacataagttcannngatcgacatg

SEQ ID NO: 4267 - DNA, 46 bp, Artificial Sequence
  Synthesized adaptor oligonucleotide
  misc_feature (34)..(36): n is a, c, g, or t
tgcaggaccagagaattcgaatacaccgttagannngatcgacatg

SEQ ID NO: 4268 - DNA, 46 bp, Artificial Sequence
  Synthesized adaptor oligonucleotide
  misc_feature (34)..(36): n is a, c, g, or t
tgcaggaccagagaattcgaatacaaagagaccnnngatcgacatg

SEQ ID NO: 4269 - DNA, 46 bp, Artificial Sequence
  Synthesized adaptor oligonucleotide
  misc_feature (34)..(36): n is a, c, g, or t
tgcaggaccagagaattcgaatacacgccctacnnntgcatcaggt

SEQ ID NO: 4270 - DNA, 46 bp, Artificial Sequence
  Synthesized adaptor oligonucleotide
  misc_feature (34)..(36): n is a, c, g, or t
tgcaggaccagagaattcgaatacagacggcctnnntgcatcaggt

SEQ ID NO: 4271 - DNA, 46 bp, Artificial Sequence
  Synthesized adaptor oligonucleotide
  misc_feature (34)..(36): n is a, c, g, or t
tgcaggaccagagaattcgaatacacgcggagannntgcatcaggt

SEQ ID NO: 4272 - DNA, 46 bp, Artificial Sequence
  Synthesized adaptor oligonucleotide
  misc_feature (34)..(36): n is a, c, g, or t
tgcaggaccagagaattcgaatacagcgataagnnntgcatcaggt

SEQ ID NO: 4273 - DNA, 46 bp, Artificial Sequence
  Synthesized adaptor oligonucleotide
  misc_feature (34)..(36): n is a, c, g, or t
tgcaggaccagagaattcgaatacaacgctagtnnntgcatcaggt

SEQ ID NO: 4274 - DNA, 46 bp, Artificial Sequence
  Synthesized adaptor oligonucleotide
  misc_feature (34)..(36): n is a, c, g, or t
tgcaggaccagagaattcgaatacatttgaatgnnntgcatcaggt

SEQ ID NO: 4275 - DNA, 46 bp, Artificial Sequence
  Synthesized adaptor oligonucleotide
  misc_feature (34)..(36): n is a, c, g, or t
tgcaggaccagagaattcgaatacatattaaatnnntgcatcaggt

SEQ ID NO: 4276 - DNA, 46 bp, Artificial Sequence
  Synthesized adaptor oligonucleotide
  misc_feature (34)..(36): n is a, c, g, or t
tgcaggaccagagaattcgaatacacgtgttgannntgcatcaggt

SEQ ID NO: 4277 - DNA, 46 bp, Artificial Sequence
  Synthesized adaptor oligonucleotide
  misc_feature (34)..(36): n is a, c, g, or t
tgcaggaccagagaattcgaatacaaagcttatnnntgcatcaggt

SEQ ID NO: 4278 - DNA, 46 bp, Artificial Sequence
  Synthesized adaptor oligonucleotide
  misc_feature (34)..(36): n is a, c, g, or t
tgcaggaccagagaattcgaatacaccccgactnnntgcatcaggt

SEQ ID NO: 4279 - DNA, 46 bp, Artificial Sequence
  Synthesized adaptor oligonucleotide
  misc_feature (34)..(36): n is a, c, g, or t
tgcaggaccagagaattcgaatacagtcgtcaannntgcatcaggt

SEQ ID NO: 4280 - DNA, 46 bp, Artificial Sequence
  Synthesized adaptor oligonucleotide
  misc_feature (34)..(36): n is a, c, g, or t
tgcaggaccagagaattcgaatacatacatcggnnntgcatcaggt

SEQ ID NO: 4281 - DNA, 46 bp, Artificial Sequence
  Synthesized adaptor oligonucleotide
  misc_feature (34)..(36): n is a, c, g, or t
tgcaggaccagagaattcgaatacagactttccnnntgcatcaggt

SEQ ID NO: 4282 - DNA, 46 bp, Artificial Sequence
  Synthesized adaptor oligonucleotide
  misc_feature (34)..(36): n is a, c, g, or t
tgcaggaccagagaattcgaatacatgccctatnnntgcatcaggt

SEQ ID NO: 4283 - DNA, 46 bp, Artificial Sequence
  Synthesized adaptor oligonucleotide
  misc_feature (34)..(36): n is a, c, g, or t
tgcaggaccagagaattcgaatacatgacggaannntgcatcaggt

SEQ ID NO: 4284 - DNA, 46 bp, Artificial Sequence
  Synthesized adaptor oligonucleotide
  misc_feature (34)..(36): n is a, c, g, or t
tgcaggaccagagaattcgaatacagctgccagnnntgcatcaggt

SEQ ID NO: 4285 - DNA, 46 bp, Artificial Sequence
  Synthesized adaptor oligonucleotide
  misc_feature (34)..(36): n is a, c, g, or t
tgcaggaccagagaattcgaatacatcatatagnnntgcatcaggt

SEQ ID NO: 4286 - DNA, 46 bp, Artificial Sequence
  Synthesized adaptor oligonucleotide
  misc_feature (34)..(36): n is a, c, g, or t
tgcaggaccagagaattcgaatacatgtgcgatnnntgcatcaggt

SEQ ID NO: 4287 - DNA, 46 bp, Artificial Sequence
  Synthesized adaptor oligonucleotide
  misc_feature (34)..(36): n is a, c, g, or t
tgcaggaccagagaattcgaatacacacgatcannntgcatcaggt

SEQ ID NO: 4288 - DNA, 46 bp, Artificial Sequence
  Synthesized adaptor oligonucleotide
  misc_feature (34)..(36): n is a, c, g, or t
tgcaggaccagagaattcgaatacagactgccgnnntgcatcaggt

SEQ ID NO: 4289 - DNA, 46 bp, Artificial Sequence
  Synthesized adaptor oligonucleotide
  misc_feature (34)..(36): n is a, c, g, or t
tgcaggaccagagaattcgaatacagtggtcatnnntgcatcaggt

SEQ ID NO: 4290 - DNA, 46 bp, Artificial Sequence
  Synthesized adaptor oligonucleotide
  misc_feature (34)..(36): n is a, c, g, or t
tgcaggaccagagaattcgaatacatgtgagctnnntgcatcaggt

SEQ ID NO: 4291 - DNA, 46 bp, Artificial Sequence
  Synthesized adaptor oligonucleotide
  misc_feature (34)..(36): n is a, c, g, or t
tgcaggaccagagaattcgaatacaaaccgtcannntgcatcaggt

SEQ ID NO: 4292 - DNA, 46 bp, Artificial Sequence
  Synthesized adaptor oligonucleotide
  misc_feature (34)..(36): n is a, c, g, or t
tgcaggaccagagaattcgaatacaattacagtnnntgcatcaggt

SEQ ID NO: 4293 - DNA, 46 bp, Artificial Sequence
  Synthesized adaptor oligonucleotide
  misc_feature (34)..(36): n is a, c, g, or t
tgcaggaccagagaattcgaatacagcaataaannntgcatcaggt

SEQ ID NO: 4294 - DNA, 46 bp, Artificial Sequence
  Synthesized adaptor oligonucleotide
  misc_feature (34)..(36): n is a, c, g, or t
tgcaggaccagagaattcgaatacaagcttagcnnntgcatcaggt

SEQ ID NO: 4295 - DNA, 46 bp, Artificial Sequence
  Synthesized adaptor oligonucleotide
  misc_feature (34)..(36): n is a, c, g, or t
tgcaggaccagagaattcgaatacatcattgccnnntgcatcaggt

SEQ ID NO: 4296 - DNA, 46 bp, Artificial Sequence
  Synthesized adaptor oligonucleotide
  misc_feature (34)..(36): n is a, c, g, or t
tgcaggaccagagaattcgaatacacactataannntgcatcaggt

SEQ ID NO: 4297 - DNA, 46 bp, Artificial Sequence
  Synthesized adaptor oligonucleotide
  misc_feature (34)..(36): n is a, c, g, or t
tgcaggaccagagaattcgaatacactgcgtccnnntgcatcaggt

SEQ ID NO: 4298 - DNA, 46 bp, Artificial Sequence
  Synthesized adaptor oligonucleotide
  misc_feature (34)..(36): n is a, c, g, or t
tgcaggaccagagaattcgaatacacgatgagannntgcatcaggt

SEQ ID NO: 4299 - DNA, 46 bp, Artificial Sequence
  Synthesized adaptor oligonucleotide
  misc_feature (34)..(36): n is a, c, g, or t
tgcaggaccagagaattcgaatacatagaaggcnnntgcatcaggt

SEQ ID NO: 4300 - DNA, 46 bp, Artificial Sequence
  Synthesized adaptor oligonucleotide
  misc_feature (34)..(36): n is a, c, g, or t
tgcaggaccagagaattcgaatacaatacaccgnnntgcatcaggt

SEQ ID NO: 4301 - DNA, 46 bp, Artificial Sequence
  Synthesized adaptor oligonucleotide
  misc_feature (34)..(36): n is a, c, g, or t
tgcaggaccagagaattcgaatacatccagcaannntgcatcaggt

SEQ ID NO: 4302 - DNA, 46 bp, Artificial Sequence
  Synthesized adaptor oligonucleotide
  misc_feature (34)..(36): n is a, c, g, or t
tgcaggaccagagaattcgaatacagtgttcctnnntgcatcaggt

SEQ ID NO: 4303 - DNA, 46 bp, Artificial Sequence
  Synthesized adaptor oligonucleotide
  misc_feature (34)..(36): n is a, c, g, or t
tgcaggaccagagaattcgaatacagaaacgtgnnntgcatcaggt

SEQ ID NO: 4304 - DNA, 46 bp, Artificial Sequence
  Synthesized adaptor oligonucleotide
  misc_feature (34)..(36): n is a, c, g, or t
tgcaggaccagagaattcgaatacaccctctaannntgcatcaggt

SEQ ID NO: 4305 - DNA, 46 bp, Artificial Sequence
  Synthesized adaptor oligonucleotide
  misc_feature (34)..(36): n is a, c, g, or t
tgcaggaccagagaattcgaatacaaccgagccnnntgcatcaggt

SEQ ID NO: 4306 - DNA, 46 bp, Artificial Sequence
  Synthesized adaptor oligonucleotide
  misc_feature (34)..(36): n is a, c, g, or t
tgcaggaccagagaattcgaatacagcgcccttnnntgcatcaggt

SEQ ID NO: 4307 - DNA, 46 bp, Artificial Sequence
  Synthesized adaptor oligonucleotide
  misc_feature (34)..(36): n is a, c, g, or t
tgcaggaccagagaattcgaatacaaaatagacnnntgcatcaggt

SEQ ID NO: 4308 - DNA, 46 bp, Artificial Sequence
  Synthesized adaptor oligonucleotide
  misc_feature (34)..(36): n is a, c, g, or t
tgcaggaccagagaattcgaatacatgacactgnnntgcatcaggt

SEQ ID NO: 4309 - DNA, 46 bp, Artificial Sequence
  Synthesized adaptor oligonucleotide
  misc_feature (34)..(36): n is a, c, g, or t
tgcaggaccagagaattcgaatacaagcgcgagnnntgcatcaggt

SEQ ID NO: 4310 - DNA, 46 bp, Artificial Sequence
  Synthesized adaptor oligonucleotide
  misc_feature (34)..(36): n is a, c, g, or t
tgcaggaccagagaattcgaatacagcagaagtnnntgcatcaggt

SEQ ID NO: 4311 - DNA, 46 bp, Artificial Sequence
  Synthesized adaptor oligonucleotide
  misc_feature (34)..(36): n is a, c, g, or t
tgcaggaccagagaattcgaatacaggctgattnnntgcatcaggt

SEQ ID NO: 4312 - DNA, 46 bp, Artificial Sequence
  Synthesized adaptor oligonucleotide
  misc_feature (34)..(36): n is a, c, g, or t
tgcaggaccagagaattcgaatacagtagaatannntgcatcaggt

SEQ ID NO: 4313 - DNA, 46 bp, Artificial Sequence
  Synthesized adaptor oligonucleotide
  misc_feature (34)..(36): n is a, c, g, or t
tgcaggaccagagaattcgaatacaccatcgaannntgcatcaggt

SEQ ID NO: 4314 - DNA, 46 bp, Artificial Sequence
  Synthesized adaptor oligonucleotide
  misc_feature (34)..(36): n is a, c, g, or t
tgcaggaccagagaattcgaatacattgcctacnnntgcatcaggt

SEQ ID NO: 4315 - DNA, 46 bp, Artificial Sequence
  Synthesized adaptor oligonucleotide
  misc_feature (34)..(36): n is a, c, g, or t
tgcaggaccagagaattcgaatacaactcccatnnntgcatcaggt

SEQ ID NO: 4316 - DNA, 46 bp, Artificial Sequence
  Synthesized adaptor oligonucleotide
  misc_feature (34)..(36): n is a, c, g, or t
tgcaggaccagagaattcgaatacagtttccacnnntgcatcaggt

SEQ ID NO: 4317 - DNA, 46 bp, Artificial Sequence
  Synthesized adaptor oligonucleotide
  misc_feature (34)..(36): n is a, c, g, or t
tgcaggaccagagaattcgaatacagatattgtnnntgcatcaggt

SEQ ID NO: 4318 - DNA, 46 bp, Artificial Sequence
  Synthesized adaptor oligonucleotide
  misc_feature (34)..(36): n is a, c, g, or t
tgcaggaccagagaattcgaatacaactgaggannntgcatcaggt

SEQ ID NO: 4319 - DNA, 46 bp, Artificial Sequence
  Synthesized adaptor oligonucleotide
  misc_feature (34)..(36): n is a, c, g, or t
tgcaggaccagagaattcgaatacagtagtctgnnntgcatcaggt

SEQ ID NO: 4320 - DNA, 46 bp, Artificial Sequence
  Synthesized adaptor oligonucleotide
  misc_feature (34)..(36): n is a, c, g, or t
tgcaggaccagagaattcgaatacatgtaaatcnnntgcatcaggt

SEQ ID NO: 4321 - DNA, 46 bp, Artificial Sequence
  Synthesized adaptor oligonucleotide
  misc_feature (34)..(36): n is a, c, g, or t
tgcaggaccagagaattcgaatacagcatatgcnnntgcatcaggt

SEQ ID NO: 4322 - DNA, 46 bp, Artificial Sequence
  Synthesized adaptor oligonucleotide
  misc_feature (34)..(36): n is a, c, g, or t
tgcaggaccagagaattcgaatacaattcgtaannntgcatcaggt

SEQ ID NO: 4323 - DNA, 46 bp, Artificial Sequence
  Synthesized adaptor oligonucleotide
  misc_feature (34)..(36): n is a, c, g, or t
tgcaggaccagagaattcgaatacaaatccacgnnntgcatcaggt

SEQ ID NO: 4324 - DNA, 46 bp, Artificial Sequence
  Synthesized adaptor oligonucleotide
  misc_feature (34)..(36): n is a, c, g, or t
tgcaggaccagagaattcgaatacagcgccgcgnnntgcatcaggt

SEQ ID NO: 4325 - DNA, 46 bp, Artificial Sequence
  Synthesized adaptor oligonucleotide
  misc_feature (34)..(36): n is a, c, g, or t
tgcaggaccagagaattcgaatacaggctcgacnnntgcatcaggt

SEQ ID NO: 4326 - DNA, 46 bp, Artificial Sequence
  Synthesized adaptor oligonucleotide
  misc_feature (34)..(36): n is a, c, g, or t
tgcaggaccagagaattcgaatacaaccccgagnnntgcatcaggt

SEQ ID NO: 4327 - DNA, 46 bp, Artificial Sequence
  Synthesized adaptor oligonucleotide
  misc_feature (34)..(36): n is a, c, g, or t
tgcaggaccagagaattcgaatacaagtcaccannntgcatcaggt

SEQ ID NO: 4328 - DNA, 46 bp, Artificial Sequence
  Synthesized adaptor oligonucleotide
  misc_feature (34)..(36): n is a, c, g, or t
tgcaggaccagagaattcgaatacaaaaattccnnntgcatcaggt

SEQ ID NO: 4329 - DNA, 46 bp, Artificial Sequence
  Synthesized adaptor oligonucleotide
  misc_feature (34)..(36): n is a, c, g, or t
tgcaggaccagagaattcgaatacagccctctgnnnacgtatgcca

SEQ ID NO: 4330 - DNA, 46 bp, Artificial Sequence
  Synthesized adaptor oligonucleotide
  misc_feature (34)..(36): n is a, c, g, or t
tgcaggaccagagaattcgaatacagcaaaggtnnnacgtatgcca

SEQ ID NO: 4331 - DNA, 46 bp, Artificial Sequence
  Synthesized adaptor oligonucleotide
  misc_feature (34)..(36): n is a, c, g, or t
tgcaggaccagagaattcgaatacatttctatgnnnacgtatgcca

SEQ ID NO: 4332 - DNA, 46 bp, Artificial Sequence
  Synthesized adaptor oligonucleotide
  misc_feature (34)..(36): n is a, c, g, or t
tgcaggaccagagaattcgaatacacgtgcaatnnnacgtatgcca

SEQ ID NO: 4333 - DNA, 46 bp, Artificial Sequence
  Synthesized adaptor oligonucleotide
  misc_feature (34)..(36): n is a, c, g, or t
tgcaggaccagagaattcgaatacagtttaggcnnnacgtatgcca

SEQ ID NO: 4334 - DNA, 46 bp, Artificial Sequence
  Synthesized adaptor oligonucleotide
  misc_feature (34)..(36): n is a, c, g, or t
tgcaggaccagagaattcgaatacaaaaatgacnnnacgtatgcca

SEQ ID NO: 4335 - DNA, 46 bp, Artificial Sequence
  Synthesized adaptor oligonucleotide
  misc_feature (34)..(36): n is a, c, g, or t
tgcaggaccagagaattcgaatacactactaggnnnacgtatgcca

SEQ ID NO: 4336 - DNA, 46 bp, Artificial Sequence
  Synthesized adaptor oligonucleotide
  misc_feature (34)..(36): n is a, c, g, or t
tgcaggaccagagaattcgaatacacacccaggnnnacgtatgcca

SEQ ID NO: 4337 - DNA, 46 bp, Artificial Sequence
  Synthesized adaptor oligonucleotide
  misc_feature (34)..(36): n is a, c, g, or t
tgcaggaccagagaattcgaatacagccgccttnnnacgtatgcca

SEQ ID NO: 4338 - DNA, 46 bp, Artificial Sequence
  Synthesized adaptor oligonucleotide
  misc_feature (34)..(36): n is a, c, g, or t
tgcaggaccagagaattcgaatacacaacgtcannnacgtatgcca

SEQ ID NO: 4339 - DNA, 46 bp, Artificial Sequence
  Synthesized adaptor oligonucleotide
  misc_feature (34)..(36): n is a, c, g, or t
tgcaggaccagagaattcgaatacatctcaaggnnnacgtatgcca

SEQ ID NO: 4340 - DNA, 46 bp, Artificial Sequence
  Synthesized adaptor oligonucleotide
  misc_feature (34)..(36): n is a, c, g, or t
tgcaggaccagagaattcgaatacatcataaacnnnacgtatgcca

SEQ ID NO: 4341 - DNA, 46 bp, Artificial Sequence
  Synthesized adaptor oligonucleotide
  misc_feature (34)..(36): n is a, c, g, or t
tgcaggaccagagaattcgaatacatcctccccnnnacgtatgcca

SEQ ID NO: 4342 - DNA, 46 bp, Artificial Sequence
  Synthesized adaptor oligonucleotide
  misc_feature (34)..(36): n is a, c, g, or t
tgcaggaccagagaattcgaatacaagtaacccnnnacgtatgcca

SEQ ID NO: 4343 - DNA, 46 bp, Artificial Sequence
  Synthesized adaptor oligonucleotide
  misc_feature (34)..(36): n is a, c, g, or t
tgcaggaccagagaattcgaatacagtgacaagnnnacgtatgcca

SEQ ID NO: 4344 - DNA, 46 bp, Artificial Sequence
  Synthesized adaptor oligonucleotide
  misc_feature (34)..(36): n is a, c, g, or t
tgcaggaccagagaattcgaatacagcaataccnnnacgtatgcca

SEQ ID NO: 4345 - DNA, 46 bp, Artificial Sequence
  Synthesized adaptor oligonucleotide
  misc_feature (34)..(36): n is a, c, g, or t
tgcaggaccagagaattcgaatacaaatacgttnnnacgtatgcca

SEQ ID NO: 4346 - DNA, 46 bp, Artificial Sequence
  Synthesized adaptor oligonucleotide
  misc_feature (34)..(36): n is a, c, g, or t
tgcaggaccagagaattcgaatacaccatgtagnnnacgtatgcca

SEQ ID NO: 4347 - DNA, 46 bp, Artificial Sequence
  Synthesized adaptor oligonucleotide
  misc_feature (34)..(36): n is a, c, g, or t
tgcaggaccagagaattcgaatacacccaacggnnnacgtatgcca

SEQ ID NO: 4348 - DNA, 46 bp, Artificial Sequence
  Synthesized adaptor oligonucleotide
  misc_feature (34)..(36): n is a, c, g, or t
tgcaggaccagagaattcgaatacagcggttgcnnnacgtatgcca

SEQ ID NO: 4349 - DNA, 46 bp, Artificial Sequence
  Synthesized adaptor oligonucleotide
  misc_feature (34)..(36): n is a, c, g, or t
tgcaggaccagagaattcgaatacagtgatctgnnnacgtatgcca

SEQ ID NO: 4350 - DNA, 46 bp, Artificial Sequence
  Synthesized adaptor oligonucleotide
  misc_feature (34)..(36): n is a, c, g, or t
tgcaggaccagagaattcgaatacataagccgtnnnacgtatgcca

SEQ ID NO: 4351 - DNA, 46 bp, Artificial Sequence
  Synthesized adaptor oligonucleotide
  misc_feature (34)..(36): n is a, c, g, or t
tgcaggaccagagaattcgaatacatgtttgttnnnacgtatgcca

SEQ ID NO: 4352 - DNA, 46 bp, Artificial Sequence
  Synthesized adaptor oligonucleotide
  misc_feature (34)..(36): n is a, c, g, or t
tgcaggaccagagaattcgaatacaacgagcggnnnacgtatgcca

SEQ ID NO: 4353 - DNA, 46 bp, Artificial Sequence
  Synthesized adaptor oligonucleotide
  misc_feature (34)..(36): n is a, c, g, or t
tgcaggaccagagaattcgaatacatagatcgcnnnacgtatgcca

SEQ ID NO: 4354 - DNA, 46 bp, Artificial Sequence
  Synthesized adaptor oligonucleotide
  misc_feature (34)..(36): n is a, c, g, or t
tgcaggaccagagaattcgaatacatgatacgcnnnacgtatgcca

SEQ ID NO: 4355 - DNA, 46 bp, Artificial Sequence
  Synthesized adaptor oligonucleotide
  misc_feature (34)..(36): n is a, c, g, or t
tgcaggaccagagaattcgaatacatagttacannnacgtatgcca

SEQ ID NO: 4356 - DNA, 46 bp, Artificial Sequence
  Synthesized adaptor oligonucleotide
  misc_feature (34)..(36): n is a, c, g, or t
tgcaggaccagagaattcgaatacacttggtgannnacgtatgcca

SEQ ID NO: 4357 - DNA, 46 bp, Artificial Sequence
  Synthesized adaptor oligonucleotide
  misc_feature (34)..(36): n is a, c, g, or t
tgcaggaccagagaattcgaatacattaatctcnnnacgtatgcca

SEQ ID NO: 4358 - DNA, 46 bp, Artificial Sequence
  Synthesized adaptor oligonucleotide
  misc_feature (34)..(36): n is a, c, g, or t
tgcaggaccagagaattcgaatacattagacgcnnnacgtatgcca

SEQ ID NO: 4359 - DNA, 46 bp, Artificial Sequence
  Synthesized adaptor oligonucleotide
  misc_feature (34)..(36): n is a, c, g, or t
tgcaggaccagagaattcgaatacaacaccagtnnnacgtatgcca

SEQ ID NO: 4360 - DNA, 46 bp, Artificial Sequence
  Synthesized adaptor oligonucleotide
  misc_feature (34)..(36): n is a, c, g, or t
tgcaggaccagagaattcgaatacaaccaggaannnacgtatgcca

SEQ ID NO: 4361 - DNA, 46 bp, Artificial Sequence
  Synthesized adaptor oligonucleotide
  misc_feature (34)..(36): n is a, c, g, or t
tgcaggaccagagaattcgaatacaatgcatgcnnnacgtatgcca

SEQ ID NO: 4362 - DNA, 46 bp, Artificial Sequence
  Synthesized adaptor oligonucleotide
  misc_feature (34)..(36): n is a, c, g, or t
tgcaggaccagagaattcgaatacatacacatannnacgtatgcca

SEQ ID NO: 4363 - DNA, 46 bp, Artificial Sequence
  Synthesized adaptor oligonucleotide
  misc_feature (34)..(36): n is a, c, g, or t
tgcaggaccagagaattcgaatacatctttcaannnacgtatgcca

SEQ ID NO: 4364 - DNA, 46 bp, Artificial Sequence
  Synthesized adaptor oligonucleotide
  misc_feature (34)..(36): n is a, c, g, or t
tgcaggaccagagaattcgaatacactatcaaannnacgtatgcca

SEQ ID NO: 4365 - DNA, 46 bp, Artificial Sequence
  Synthesized adaptor oligonucleotide
  misc_feature (34)..(36): n is a, c, g, or t
tgcaggaccagagaattcgaatacattaccaaannnacgtatgcca

SEQ ID NO: 4366 - DNA, 46 bp, Artificial Sequence
  Synthesized adaptor oligonucleotide
  misc_feature (34)..(36): n is a, c, g, or t
tgcaggaccagagaattcgaatacaccggcgatnnnacgtatgcca

SEQ ID NO: 4367 - DNA, 46 bp, Artificial Sequence
  Synthesized adaptor oligonucleotide
  misc_feature (34)..(36): n is a, c, g, or t
tgcaggaccagagaattcgaatacagttgtatannnacgtatgcca

SEQ ID NO: 4368 - DNA, 46 bp, Artificial Sequence
  Synthesized adaptor oligonucleotide
  misc_feature (34)..(36): n is a, c, g, or t
tgcaggaccagagaattcgaatacaatacggctnnnacgtatgcca

SEQ ID NO: 4369 - DNA, 46 bp, Artificial Sequence
  Synthesized adaptor oligonucleotide
  misc_feature (34)..(36): n is a, c, g, or t
tgcaggaccagagaattcgaatacatggcaactnnnacgtatgcca

SEQ ID NO: 4370 - DNA, 46 bp, Artificial Sequence
  Synthesized adaptor oligonucleotide
  misc_feature (34)..(36): n is a, c, g, or t
tgcaggaccagagaattcgaatacagatttcaannnacgtatgcca

SEQ ID NO: 4371 - DNA, 46 bp, Artificial Sequence
  Synthesized adaptor oligonucleotide
  misc_feature (34)..(36): n is a, c, g, or t
tgcaggaccagagaattcgaatacagtatctttnnnacgtatgcca

SEQ ID NO: 4372 - DNA, 46 bp, Artificial Sequence
  Synthesized adaptor oligonucleotide
  misc_feature (34)..(36): n is a, c, g, or t
tgcaggaccagagaattcgaatacagcaacagannnacgtatgcca

SEQ ID NO: 4373 - DNA, 46 bp, Artificial Sequence
  Synthesized adaptor oligonucleotide
  misc_feature (34)..(36): n is a, c, g, or t
tgcaggaccagagaattcgaatacagcgttcaannnacgtatgcca

SEQ ID NO: 4374 - DNA, 46 bp, Artificial Sequence
  Synthesized adaptor oligonucleotide
  misc_feature (34)..(36): n is a, c, g, or t
tgcaggaccagagaattcgaatacagtattcggnnnacgtatgcca

SEQ ID NO: 4375 - DNA, 46 bp, Artificial Sequence
  Synthesized adaptor oligonucleotide
  misc_feature (34)..(36): n is a, c, g, or t
tgcaggaccagagaattcgaatacatcctatatnnnacgtatgcca

SEQ ID NO: 4376 - DNA, 46 bp, Artificial Sequence
  Synthesized adaptor oligonucleotide
  misc_feature (34)..(36): n is a, c, g, or t
tgcaggaccagagaattcgaatacaagtcgtacnnnacgtatgcca

SEQ ID NO: 4377 - DNA, 46 bp, Artificial Sequence
  Synthesized adaptor oligonucleotide
  misc_feature (34)..(36): n is a, c, g, or t
tgcaggaccagagaattcgaatacacctagacannnacgtatgcca

SEQ ID NO: 4378 - DNA, 46 bp, Artificial Sequence
  Synthesized adaptor oligonucleotide
  misc_feature (34)..(36): n is a, c, g, or t
tgcaggaccagagaattcgaatacaattggtcgnnnacgtatgcca

SEQ ID NO: 4379 - DNA, 46 bp, Artificial Sequence
  Synthesized adaptor oligonucleotide
  misc_feature (34)..(36): n is a, c, g, or t
tgcaggaccagagaattcgaatacaggtcacgcnnnacgtatgcca

SEQ ID NO: 4380 - DNA, 46 bp, Artificial Sequence
  Synthesized adaptor oligonucleotide
  misc_feature (34)..(36): n is a, c, g, or t
tgcaggaccagagaattcgaatacacaccaaacnnnacgtatgcca

SEQ ID NO: 4381 - DNA, 46 bp, Artificial Sequence
  Synthesized adaptor oligonucleotide
  misc_feature (34)..(36): n is a, c, g, or t
tgcaggaccagagaattcgaatacagaattcatnnnacgtatgcca

SEQ ID NO: 4382 - DNA, 46 bp, Artificial Sequence
  Synthesized adaptor oligonucleotide
  misc_feature (34)..(36): n is a, c, g, or t
tgcaggaccagagaattcgaatacattcgcactnnnacgtatgcca

SEQ ID NO: 4383 - DNA, 46 bp, Artificial Sequence
  Synthesized adaptor oligonucleotide
  misc_feature (34)..(36): n is a, c, g, or t
tgcaggaccagagaattcgaatacaccgttaagnnnacgtatgcca

SEQ ID NO: 4384 - DNA, 46 bp, Artificial Sequence
  Synthesized adaptor oligonucleotide
  misc_feature (34)..(36): n is a, c, g, or t
tgcaggaccagagaattcgaatacacgcctgctnnnacgtatgcca

SEQ ID NO: 4385 - DNA, 46 bp, Artificial Sequence
  Synthesized adaptor oligonucleotide
  misc_feature (34)..(36): n is a, c, g, or t
tgcaggaccagagaattcgaatacaaaaacagtnnnacgtatgcca

SEQ ID NO: 4386 - DNA, 46 bp, Artificial Sequence
  Synthesized adaptor oligonucleotide
  misc_feature (34)..(36): n is a, c, g, or t
tgcaggaccagagaattcgaatacagagattttnnnacgtatgcca

SEQ ID NO: 4387 - DNA, 46 bp, Artificial Sequence
  Synthesized adaptor oligonucleotide
  misc_feature (34)..(36): n is a, c, g, or t
tgcaggaccagagaattcgaatacaaccagttgnnnacgtatgcca

SEQ ID NO: 4388 - DNA, 46 bp, Artificial Sequence
  Synthesized adaptor oligonucleotide
  misc_feature (34)..(36): n is a, c, g, or t
tgcaggaccagagaattcgaatacaagttcgcannnacgtatgcca

SEQ ID NO: 4389 - DNA, 46 bp, Artificial Sequence
  Synthesized adaptor oligonucleotide
  misc_feature (34)..(36): n is a, c, g, or t
tgcaggaccagagaattcgaatacagatgacctnnnctagcgttac

SEQ ID NO: 4390 - DNA, 46 bp, Artificial Sequence
  Synthesized adaptor oligonucleotide
  misc_feature (34)..(36): n is a, c, g, or t
tgcaggaccagagaattcgaatacacacgtatgnnnctagcgttac

SEQ ID NO: 4391 - DNA, 46 bp, Artificial Sequence
  Synthesized adaptor oligonucleotide
  misc_feature (34)..(36): n is a, c, g, or t
tgcaggaccagagaattcgaatacatgtcggcgnnnctagcgttac

SEQ ID NO: 4392 - DNA, 46 bp, Artificial Sequence
  Synthesized adaptor oligonucleotide
  misc_feature (34)..(36): n is a, c, g, or t
tgcaggaccagagaattcgaatacagaccaaagnnnctagcgttac

SEQ ID NO: 4393 - DNA, 46 bp, Artificial Sequence
  Synthesized adaptor oligonucleotide
  misc_feature (34)..(36): n is a, c, g, or t
tgcaggaccagagaattcgaatacactgctactnnnctagcgttac

SEQ ID NO: 4394 - DNA, 46 bp, Artificial Sequence
  Synthesized adaptor oligonucleotide
  misc_feature (34)..(36): n is a, c, g, or t
tgcaggaccagagaattcgaatacactccaactnnnctagcgttac

SEQ ID NO: 4395 - DNA, 46 bp, Artificial Sequence
  Synthesized adaptor oligonucleotide
  misc_feature (34)..(36): n is a, c, g, or t
tgcaggaccagagaattcgaatacacaatccctnnnctagcgttac

SEQ ID NO: 4396 - DNA, 46 bp, Artificial Sequence
  Synthesized adaptor oligonucleotide
  misc_feature (34)..(36): n is a, c, g, or t
tgcaggaccagagaattcgaatacatcgtgcaannnctagcgttac

SEQ ID NO: 4397 - DNA, 46 bp, Artificial Sequence
  Synthesized adaptor oligonucleotide
  misc_feature (34)..(36): n is a, c, g, or t
tgcaggaccagagaattcgaatacaaagccatcnnnctagcgttac

SEQ ID NO: 4398 - DNA, 46 bp, Artificial Sequence
  Synthesized adaptor oligonucleotide
  misc_feature (34)..(36): n is a, c, g, or t
tgcaggaccagagaattcgaatacaatgaacttnnnctagcgttac

SEQ ID NO: 4399 - DNA, 46 bp, Artificial Sequence
  Synthesized adaptor oligonucleotide
  misc_feature (34)..(36): n is a, c, g, or t
tgcaggaccagagaattcgaatacatggccggtnnnctagcgttac

SEQ ID NO: 4400 - DNA, 46 bp, Artificial Sequence
  Synthesized adaptor oligonucleotide
  misc_feature (34)..(36): n is a, c, g, or t
tgcaggaccagagaattcgaatacatgccacggnnnctagcgttac

SEQ ID NO: 4401 - DNA, 46 bp, Artificial Sequence
  Synthesized adaptor oligonucleotide
  misc_feature (34)..(36): n is a, c, g, or t
tgcaggaccagagaattcgaatacagtcttcgtnnnctagcgttac

SEQ ID NO: 4402 - DNA, 46 bp, Artificial Sequence
  Synthesized adaptor oligonucleotide
  misc_feature (34)..(36): n is a, c, g, or t
tgcaggaccagagaattcgaatacaaacgtaggnnnctagcgttac

SEQ ID NO: 4403 - DNA, 46 bp, Artificial Sequence
  Synthesized adaptor oligonucleotide
  misc_feature (34)..(36): n is a, c, g, or t
tgcaggaccagagaattcgaatacaatggagcannnctagcgttac

SEQ ID NO: 4404 - DNA, 46 bp, Artificial Sequence
  Synthesized adaptor oligonucleotide
  misc_feature (34)..(36): n is a, c, g, or t
tgcaggaccagagaattcgaatacatgacggccnnnctagcgttac

SEQ ID NO: 4405 - DNA, 46 bp, Artificial Sequence
  Synthesized adaptor oligonucleotide
  misc_feature (34)..(36): n is a, c, g, or t
tgcaggaccagagaattcgaatacacttaggacnnnctagcgttac

SEQ ID NO: 4406 - DNA, 46 bp, Artificial Sequence
  Synthesized adaptor oligonucleotide
  misc_feature (34)..(36): n is a, c, g, or t
tgcaggaccagagaattcgaatacagacagagtnnnctagcgttac

SEQ ID NO: 4407 - DNA, 46 bp, Artificial Sequence
  Synthesized adaptor oligonucleotide
  misc_feature (34)..(36): n is a, c, g, or t
tgcaggaccagagaattcgaatacaaagtcgtcnnnctagcgttac

SEQ ID NO: 4408 - DNA, 46 bp, Artificial Sequence
  Synthesized adaptor oligonucleotide
  misc_feature (34)..(36): n is a, c, g, or t
tgcaggaccagagaattcgaatacatacaaaagnnnctagcgttac

SEQ ID NO: 4409 - DNA, 46 bp, Artificial Sequence
  Synthesized adaptor oligonucleotide
  misc_feature (34)..(36): n is a, c, g, or t
tgcaggaccagagaattcgaatacatctcctgannnctagcgttac

SEQ ID NO: 4410 - DNA, 46 bp, Artificial Sequence
  Synthesized adaptor oligonucleotide
  misc_feature (34)..(36): n is a, c, g, or t
tgcaggaccagagaattcgaatacaagctggttnnnctagcgttac

SEQ ID NO: 4411 - DNA, 46 bp, Artificial Sequence
  Synthesized adaptor oligonucleotide
  misc_feature (34)..(36): n is a, c, g, or t
tgcaggaccagagaattcgaatacaaatcaagannnctagcgttac

SEQ ID NO: 4412 - DNA, 46 bp, Artificial Sequence
  Synthesized adaptor oligonucleotide
  misc_feature (34)..(36): n is a, c, g, or t
tgcaggaccagagaattcgaatacaaccacaacnnnctagcgttac

SEQ ID NO: 4413 - DNA, 46 bp, Artificial Sequence
  Synthesized adaptor oligonucleotide
  misc_feature (34)..(36): n is a, c, g, or t
tgcaggaccagagaattcgaatacagctataatnnnctagcgttac

SEQ ID NO: 4414 - DNA, 46 bp, Artificial Sequence
  Synthesized adaptor oligonucleotide
  misc_feature (34)..(36): n is a, c, g, or t
tgcaggaccagagaattcgaatacaggaccgctnnnctagcgttac

SEQ ID NO: 4415 - DNA, 46 bp, Artificial Sequence
  Synthesized adaptor oligonucleotide
  misc_feature (34)..(36): n is a, c, g, or t
tgcaggaccagagaattcgaatacagtccctatnnnctagcgttac

SEQ ID NO: 4416 - DNA, 46 bp, Artificial Sequence
  Synthesized adaptor oligonucleotide
  misc_feature (34)..(36): n is a, c, g, or t
tgcaggaccagagaattcgaatacattgctgagnnnctagcgttac

SEQ ID NO: 4417 - DNA, 46 bp, Artificial Sequence
  Synthesized adaptor oligonucleotide
  misc_feature (34)..(36): n is a, c, g, or t
tgcaggaccagagaattcgaatacattggccttnnnctagcgttac

SEQ ID NO: 4418 - DNA, 46 bp, Artificial Sequence
  Synthesized adaptor oligonucleotide
  misc_feature (34)..(36): n is a, c, g, or t
tgcaggaccagagaattcgaatacaatcatttcnnnctagcgttac

SEQ ID NO: 4419 - DNA, 46 bp, Artificial Sequence
  Synthesized adaptor oligonucleotide
  misc_feature (34)..(36): n is a, c, g, or t
tgcaggaccagagaattcgaatacagatgtattnnnctagcgttac

SEQ ID NO: 4420 - DNA, 46 bp, Artificial Sequence
  Synthesized adaptor oligonucleotide
  misc_feature (34)..(36): n is a, c, g, or t
tgcaggaccagagaattcgaatacagatcatatnnnctagcgttac

SEQ ID NO: 4421 - DNA, 46 bp, Artificial Sequence
  Synthesized adaptor oligonucleotide
  misc_feature (34)..(36): n is a, c, g, or t
tgcaggaccagagaattcgaatacaccccgctannnctagcgttac

SEQ ID NO: 4422 - DNA, 46 bp, Artificial Sequence
  Synthesized adaptor oligonucleotide
  misc_feature (34)..(36): n is a, c, g, or t
tgcaggaccagagaattcgaatacaaaaatcgannnctagcgttac

SEQ ID NO: 4423 - DNA, 46 bp, Artificial Sequence
  Synthesized adaptor oligonucleotide
  misc_feature (34)..(36): n is a, c, g, or t
tgcaggaccagagaattcgaatacaatgtacatnnnctagcgttac

SEQ ID NO: 4424 - DNA, 46 bp, Artificial Sequence
  Synthesized adaptor oligonucleotide
  misc_feature (34)..(36): n is a, c, g, or t
tgcaggaccagagaattcgaatacagccatcttnnnctagcgttac

SEQ ID NO: 4425 - DNA, 46 bp, Artificial Sequence
  Synthesized adaptor oligonucleotide
  misc_feature (34)..(36): n is a, c, g, or t
tgcaggaccagagaattcgaatacaaatgctcgnnnctagcgttac

SEQ ID NO: 4426 - DNA, 46 bp, Artificial Sequence
  Synthesized adaptor oligonucleotide
  misc_feature (34)..(36): n is a, c, g, or t
tgcaggaccagagaattcgaatacacacgtcggnnnctagcgttac

SEQ ID NO: 4427 - DNA, 46 bp, Artificial Sequence
  Synthesized adaptor oligonucleotide
  misc_feature (34)..(36): n is a, c, g, or t
tgcaggaccagagaattcgaatacactatgcgannnctagcgttac

SEQ ID NO: 4428 - DNA, 46 bp, Artificial Sequence
  Synthesized adaptor oligonucleotide
  misc_feature (34)..(36): n is a, c, g, or t
tgcaggaccagagaattcgaatacagtctggtannnctagcgttac

SEQ ID NO: 4429 - DNA, 46 bp, Artificial Sequence
  Synthesized adaptor oligonucleotide
  misc_feature (34)..(36): n is a, c, g, or t
tgcaggaccagagaattcgaatacagtcagtgtnnnctagcgttac

SEQ ID NO: 4430 - DNA, 46 bp, Artificial Sequence
  Synthesized adaptor oligonucleotide
  misc_feature (34)..(36): n is a, c, g, or t
tgcaggaccagagaattcgaatacactccagttnnnctagcgttac

SEQ ID NO: 4431 - DNA, 46 bp, Artificial Sequence
  Synthesized adaptor oligonucleotide
  misc_feature (34)..(36): n is a, c, g, or t
tgcaggaccagagaattcgaatacagatgaagcnnnctagcgttac

SEQ ID NO: 4432 - DNA, 46 bp, Artificial Sequence
  Synthesized adaptor oligonucleotide
  misc_feature (34)..(36): n is a, c, g, or t
tgcaggaccagagaattcgaatacaaaaccattnnnctagcgttac

SEQ ID NO: 4433 - DNA, 46 bp, Artificial Sequence
  Synthesized adaptor oligonucleotide
  misc_feature (34)..(36): n is a, c, g, or t
tgcaggaccagagaattcgaatacacctgcgctnnnctagcgttac

SEQ ID NO: 4434 - DNA, 46 bp, Artificial Sequence
  Synthesized adaptor oligonucleotide
  misc_feature (34)..(36): n is a, c, g, or t
tgcaggaccagagaattcgaatacacacccgagnnnctagcgttac

SEQ ID NO: 4435 - DNA, 46 bp, Artificial Sequence
  Synthesized adaptor oligonucleotide
  misc_feature (34)..(36): n is a, c, g, or t
tgcaggaccagagaattcgaatacatactacaannnctagcgttac

SEQ ID NO: 4436 - DNA, 46 bp, Artificial Sequence
  Synthesized adaptor oligonucleotide
  misc_feature (34)..(36): n is a, c, g, or t
tgcaggaccagagaattcgaatacataaccgacnnnctagcgttac

SEQ ID NO: 4437 - DNA, 46 bp, Artificial Sequence
  Synthesized adaptor oligonucleotide
  misc_feature (34)..(36): n is a, c, g, or t
tgcaggaccagagaattcgaatacatctatagannnctagcgttac

SEQ ID NO: 4438 - DNA, 46 bp, Artificial Sequence
  Synthesized adaptor oligonucleotide
  misc_feature (34)..(36): n is a, c, g, or t
tgcaggaccagagaattcgaatacaggtgaggcnnnctagcgttac

SEQ ID NO: 4439 - DNA, 46 bp, Artificial Sequence
  Synthesized adaptor oligonucleotide
  misc_feature (34)..(36): n is a, c, g, or t
tgcaggaccagagaattcgaatacacatactccnnnctagcgttac

SEQ ID NO: 4440 - DNA, 46 bp, Artificial Sequence
  Synthesized adaptor oligonucleotide
  misc_feature (34)..(36): n is a, c, g, or t
tgcaggaccagagaattcgaatacataagagtannnctagcgttac

SEQ ID NO: 4441 - DNA, 46 bp, Artificial Sequence
  Synthesized adaptor oligonucleotide
  misc_feature (34)..(36): n is a, c, g, or t
tgcaggaccagagaattcgaatacagtgtgagannnctagcgttac

SEQ ID NO: 4442 - DNA, 46 bp, Artificial Sequence
  Synthesized adaptor oligonucleotide
  misc_feature (34)..(36): n is a, c, g, or t
tgcaggaccagagaattcgaatacattcccgatnnnctagcgttac

SEQ ID NO: 4443 - DNA, 46 bp, Artificial Sequence
  Synthesized adaptor oligonucleotide
  misc_feature (34)..(36): n is a, c, g, or t
tgcaggaccagagaattcgaatacaagtacgagnnnctagcgttac

SEQ ID NO: 4444 - DNA, 46 bp, Artificial Sequence
  Synthesized adaptor oligonucleotide
  misc_feature (34)..(36): n is a, c, g, or t
tgcaggaccagagaattcgaatacaggtgaacannnctagcgttac

SEQ ID NO: 4445 - DNA, 46 bp, Artificial Sequence
  Synthesized adaptor oligonucleotide
  misc_feature (34)..(36): n is a, c, g, or t
tgcaggaccagagaattcgaatacacactagcannnctagcgttac

SEQ ID NO: 4446 - DNA, 46 bp, Artificial Sequence
  Synthesized adaptor oligonucleotide
  misc_feature (34)..(36): n is a, c, g, or t
tgcaggaccagagaattcgaatacaagcagaacnnnctagcgttac

SEQ ID NO: 4447 - DNA, 46 bp, Artificial Sequence
  Synthesized adaptor oligonucleotide
  misc_feature (34)..(36): n is a, c, g, or t
tgcaggaccagagaattcgaatacattttaaaannnctagcgttac

SEQ ID NO: 4448 - DNA, 46 bp, Artificial Sequence
  Synthesized adaptor oligonucleotide
  misc_feature (34)..(36): n is a, c, g, or t
tgcaggaccagagaattcgaatacacttcgagannnctagcgttac

SEQ ID NO: 4449 - DNA, 46 bp, Artificial Sequence
  Synthesized adaptor oligonucleotide
  misc_feature (34)..(36): n is a, c, g, or t
tgcaggaccagagaattcgaatacatgcaatgcnnngatcgacatg

SEQ ID NO: 4450 - DNA, 46 bp, Artificial Sequence
  Synthesized adaptor oligonucleotide
  misc_feature (34)..(36): n is a, c, g, or t
tgcaggaccagagaattcgaatacagacgccacnnngatcgacatg

SEQ ID NO: 4451 - DNA, 46 bp, Artificial Sequence
  Synthesized adaptor oligonucleotide
  misc_feature (34)..(36): n is a, c, g, or t
tgcaggaccagagaattcgaatacagtttttcannngatcgacatg

SEQ ID NO: 4452 - DNA, 46 bp, Artificial Sequence
  Synthesized adaptor oligonucleotide
  misc_feature (34)..(36): n is a, c, g, or t
tgcaggaccagagaattcgaatacagttttatcnnngatcgacatg

SEQ ID NO: 4453 - DNA, 46 bp, Artificial Sequence
  Synthesized adaptor oligonucleotide
  misc_feature (34)..(36): n is a, c, g, or t
tgcaggaccagagaattcgaatacaacaccggcnnngatcgacatg

SEQ ID NO: 4454 - DNA, 46 bp, Artificial Sequence
  Synthesized adaptor oligonucleotide
  misc_feature (34)..(36): n is a, c, g, or t
tgcaggaccagagaattcgaatacacgctttacnnngatcgacatg

SEQ ID NO: 4455 - DNA, 46 bp, Artificial Sequence
  Synthesized adaptor oligonucleotide
  misc_feature (34)..(36): n is a, c, g, or t
tgcaggaccagagaattcgaatacagtaaatgannngatcgacatg

SEQ ID NO: 4456 - DNA, 46 bp, Artificial Sequence
  Synthesized adaptor oligonucleotide
  misc_feature (34)..(36): n is a, c, g, or t
tgcaggaccagagaattcgaatacatttgaagtnnngatcgacatg

SEQ ID NO: 4457 - DNA, 46 bp, Artificial Sequence
  Synthesized adaptor oligonucleotide
  misc_feature (34)..(36): n is a, c, g, or t
tgcaggaccagagaattcgaatacacaccacttnnngatcgacatg

SEQ ID NO: 4458 - DNA, 46 bp, Artificial Sequence
  Synthesized adaptor oligonucleotide
  misc_feature (34)..(36): n is a, c, g, or t
tgcaggaccagagaattcgaatacatgtaagaannngatcgacatg

SEQ ID NO: 4459 - DNA, 46 bp, Artificial Sequence
  Synthesized adaptor oligonucleotide
  misc_feature (34)..(36): n is a, c, g, or t
tgcaggaccagagaattcgaatacacgctgaatnnngatcgacatg

SEQ ID NO: 4460 - DNA, 46 bp, Artificial Sequence
  Synthesized adaptor oligonucleotide
  misc_feature (34)..(36): n is a, c, g, or t
tgcaggaccagagaattcgaatacacttattgtnnngatcgacatg

SEQ ID NO: 4461 - DNA, 46 bp, Artificial Sequence
  Synthesized adaptor oligonucleotide
  misc_feature (34)..(36): n is a, c, g, or t
tgcaggaccagagaattcgaatacacgtgagaannngatcgacatg

SEQ ID NO: 4462 - DNA, 46 bp, Artificial Sequence
  Synthesized adaptor oligonucleotide
  misc_feature (34)..(36): n is a, c, g, or t
tgcaggaccagagaattcgaatacaaccggctgnnngatcgacatg

SEQ ID NO: 4463 - DNA, 46 bp, Artificial Sequence
  Synthesized adaptor oligonucleotide
  misc_feature (34)..(36): n is a, c, g, or t
tgcaggaccagagaattcgaatacacaaaattcnnngatcgacatg

SEQ ID NO: 4464 - DNA, 46 bp, Artificial Sequence
  Synthesized adaptor oligonucleotide
  misc_feature (34)..(36): n is a, c, g, or t
tgcaggaccagagaattcgaatacaactaaagannngatcgacatg

SEQ ID NO: 4465 - DNA, 46 bp, Artificial Sequence
  Synthesized adaptor oligonucleotide
  misc_feature (34)..(36): n is a, c, g, or t
tgcaggaccagagaattcgaatacatagtctccnnngatcgacatg

SEQ ID NO: 4466 - DNA, 46 bp, Artificial Sequence
  Synthesized adaptor oligonucleotide
  misc_feature (34)..(36): n is a, c, g, or t
tgcaggaccagagaattcgaatacactaacatannngatcgacatg

SEQ ID NO: 4467 - DNA, 46 bp, Artificial Sequence
  Synthesized adaptor oligonucleotide
  misc_feature (34)..(36): n is a, c, g, or t
tgcaggaccagagaattcgaatacatgcacgcgnnngatcgacatg

SEQ ID NO: 4468 - DNA, 46 bp, Artificial Sequence
  Synthesized adaptor oligonucleotide
  misc_feature (34)..(36): n is a, c, g, or t
tgcaggaccagagaattcgaatacaactggaagnnngatcgacatg

SEQ ID NO: 4469 - DNA, 46 bp, Artificial Sequence
  Synthesized adaptor oligonucleotide
  misc_feature (34)..(36): n is a, c, g, or t
tgcaggaccagagaattcgaatacagcaatccannngatcgacatg

SEQ ID NO: 4470 - DNA, 46 bp, Artificial Sequence
  Synthesized adaptor oligonucleotide
  misc_feature (34)..(36): n is a, c, g, or t
tgcaggaccagagaattcgaatacaaatcctaannngatcgacatg

SEQ ID NO: 4471 - DNA, 46 bp, Artificial Sequence
  Synthesized adaptor oligonucleotide
  misc_feature (34)..(36): n is a, c, g, or t
tgcaggaccagagaattcgaatacaaagcggtannngatcgacatg

SEQ ID NO: 4472 - DNA, 46 bp, Artificial Sequence
  Synthesized adaptor oligonucleotide
  misc_feature (34)..(36): n is a, c, g, or t
tgcaggaccagagaattcgaatacagtcagagannngatcgacatg

SEQ ID NO: 4473 - DNA, 46 bp, Artificial Sequence
  Synthesized adaptor oligonucleotide
  misc_feature (34)..(36): n is a, c, g, or t
tgcaggaccagagaattcgaatacatcggatgtnnngatcgacatg

SEQ ID NO: 4474 - DNA, 46 bp, Artificial Sequence
  Synthesized adaptor oligonucleotide
  misc_feature (34)..(36): n is a, c, g, or t
tgcaggaccagagaattcgaatacatcacgcttnnngatcgacatg

SEQ ID NO: 4475 - DNA, 46 bp, Artificial Sequence
  Synthesized adaptor oligonucleotide
  misc_feature (34)..(36): n is a, c, g, or t
tgcaggaccagagaattcgaatacattaggtgcnnngatcgacatg

SEQ ID NO: 4476 - DNA, 46 bp, Artificial Sequence
  Synthesized adaptor oligonucleotide
  misc_feature (34)..(36): n is a, c, g, or t
tgcaggaccagagaattcgaatacatccgacggnnngatcgacatg

SEQ ID NO: 4477 - DNA, 46 bp, Artificial Sequence
  Synthesized adaptor oligonucleotide
  misc_feature (34)..(36): n is a, c, g, or t
tgcaggaccagagaattcgaatacaaaagcagcnnngatcgacatg

SEQ ID NO: 4478 - DNA, 46 bp, Artificial Sequence
  Synthesized adaptor oligonucleotide
  misc_feature (34)..(36): n is a, c, g, or t
tgcaggaccagagaattcgaatacagtgccggtnnngatcgacatg

SEQ ID NO: 4479 - DNA, 46 bp, Artificial Sequence
  Synthesized adaptor oligonucleotide
  misc_feature (34)..(36): n is a, c, g, or t
tgcaggaccagagaattcgaatacaacgatattnnngatcgacatg

SEQ ID NO: 4480 - DNA, 46 bp, Artificial Sequence
  Synthesized adaptor oligonucleotide
  misc_feature (34)..(36): n is a, c, g, or t
tgcaggaccagagaattcgaatacaacaacaggnnngatcgacatg

SEQ ID NO: 4481 - DNA, 46 bp, Artificial Sequence
  Synthesized adaptor oligonucleotide
  misc_feature (34)..(36): n is a, c, g, or t
tgcaggaccagagaattcgaatacactccgaaannngatcgacatg

SEQ ID NO: 4482 - DNA, 46 bp, Artificial Sequence
  Synthesized adaptor oligonucleotide
  misc_feature (34)..(36): n is a, c, g, or t
tgcaggaccagagaattcgaatacatcaagccannngatcgacatg

SEQ ID NO: 4483 - DNA, 46 bp, Artificial Sequence
  Synthesized adaptor oligonucleotide
  misc_feature (34)..(36): n is a, c, g, or t
tgcaggaccagagaattcgaatacacattaacannngatcgacatg

SEQ ID NO: 4484 - DNA, 46 bp, Artificial Sequence
  Synthesized adaptor oligonucleotide
  misc_feature (34)..(36): n is a, c, g, or t
tgcaggaccagagaattcgaatacaaacacgagnnngatcgacatg

SEQ ID NO: 4485 - DNA, 46 bp, Artificial Sequence
  Synthesized adaptor oligonucleotide
  misc_feature (34)..(36): n is a, c, g, or t
tgcaggaccagagaattcgaatacatccatcacnnngatcgacatg

SEQ ID NO: 4486 - DNA, 46 bp, Artificial Sequence
  Synthesized adaptor oligonucleotide
  misc_feature (34)..(36): n is a, c, g, or t
tgcaggaccagagaattcgaatacagtcgcacgnnngatcgacatg

SEQ ID NO: 4487 - DNA, 46 bp, Artificial Sequence
  Synthesized adaptor oligonucleotide
  misc_feature (34)..(36): n is a, c, g, or t
tgcaggaccagagaattcgaatacatggcacgcnnngatcgacatg

SEQ ID NO: 4488 - DNA, 46 bp, Artificial Sequence
  Synthesized adaptor oligonucleotide
  misc_feature (34)..(36): n is a, c, g, or t
tgcaggaccagagaattcgaatacatttcagaannngatcgacatg

SEQ ID NO: 4489 - DNA, 46 bp, Artificial Sequence
  Synthesized adaptor oligonucleotide
  misc_feature (34)..(36): n is a, c, g, or t
tgcaggaccagagaattcgaatacatacgtctcnnngatcgacatg

SEQ ID NO: 4490 - DNA, 46 bp, Artificial Sequence
  Synthesized adaptor oligonucleotide
  misc_feature (34)..(36): n is a, c, g, or t
tgcaggaccagagaattcgaatacaccgatcttnnngatcgacatg

SEQ ID NO: 4491 - DNA, 46 bp, Artificial Sequence
  Synthesized adaptor oligonucleotide
  misc_feature (34)..(36): n is a, c, g, or t
tgcaggaccagagaattcgaatacaattaagctnnngatcgacatg

SEQ ID NO: 4492 - DNA, 46 bp, Artificial Sequence
  Synthesized adaptor oligonucleotide
  misc_feature (34)..(36): n is a, c, g, or t
tgcaggaccagagaattcgaatacaaacttcccnnngatcgacatg

SEQ ID NO: 4493 - DNA, 46 bp, Artificial Sequence
  Synthesized adaptor oligonucleotide
  misc_feature (34)..(36): n is a, c, g, or t
tgcaggaccagagaattcgaatacagtcgctttnnngatcgacatg

SEQ ID NO: 4494 - DNA, 46 bp, Artificial Sequence
  Synthesized adaptor oligonucleotide
  misc_feature (34)..(36): n is a, c, g, or t
tgcaggaccagagaattcgaatacagccagtatnnngatcgacatg

SEQ ID NO: 4495 - DNA, 46 bp, Artificial Sequence
  Synthesized adaptor oligonucleotide
  misc_feature (34)..(36): n is a, c, g, or t
tgcaggaccagagaattcgaatacagagaaaaannngatcgacatg

SEQ ID NO: 4496 - DNA, 46 bp, Artificial Sequence
  Synthesized adaptor oligonucleotide
  misc_feature (34)..(36): n is a, c, g, or t
tgcaggaccagagaattcgaatacaatagcccannngatcgacatg

SEQ ID NO: 4497 - DNA, 46 bp, Artificial Sequence
  Synthesized adaptor oligonucleotide
  misc_feature (34)..(36): n is a, c, g, or t
tgcaggaccagagaattcgaatacacacgtcccnnngatcgacatg

SEQ ID NO: 4498 - DNA, 46 bp, Artificial Sequence
  Synthesized adaptor oligonucleotide
  misc_feature (34)..(36): n is a, c, g, or t
tgcaggaccagagaattcgaatacaaagttatcnnngatcgacatg

SEQ ID NO: 4499 - DNA, 46 bp, Artificial Sequence
  Synthesized adaptor oligonucleotide
  misc_feature (34)..(36): n is a, c, g, or t
tgcaggaccagagaattcgaatacacttttcggnnngatcgacatg

SEQ ID NO: 4500 - DNA, 46 bp, Artificial Sequence
  Synthesized adaptor oligonucleotide
  misc_feature (34)..(36): n is a, c, g, or t
tgcaggaccagagaattcgaatacacaatcgtgnnngatcgacatg

SEQ ID NO: 4501 - DNA, 46 bp, Artificial Sequence
  Synthesized adaptor oligonucleotide
  misc_feature (34)..(36): n is a, c, g, or t
tgcaggaccagagaattcgaatacaggacgtaannngatcgacatg

SEQ ID NO: 4502 - DNA, 46 bp, Artificial Sequence
  Synthesized adaptor oligonucleotide
  misc_feature (34)..(36): n is a, c, g, or t
tgcaggaccagagaattcgaatacacccgaacgnnngatcgacatg

SEQ ID NO: 4503 - DNA, 46 bp, Artificial Sequence
  Synthesized adaptor oligonucleotide
  misc_feature (34)..(36): n is a, c, g, or t
tgcaggaccagagaattcgaatacatccgtatcnnngatcgacatg

SEQ ID NO: 4504 - DNA, 46 bp, Artificial Sequence
  Synthesized adaptor oligonucleotide
  misc_feature (34)..(36): n is a, c, g, or t
tgcaggaccagagaattcgaatacatttcgttannngatcgacatg

SEQ ID NO: 4505 - DNA, 46 bp, Artificial Sequence
  Synthesized adaptor oligonucleotide
  misc_feature (34)..(36): n is a, c, g, or t
tgcaggaccagagaattcgaatacatgctacagnnngatcgacatg

SEQ ID NO: 4506 - DNA, 46 bp, Artificial Sequence
  Synthesized adaptor oligonucleotide
  misc_feature (34)..(36): n is a, c, g, or t
tgcaggaccagagaattcgaatacagttactttnnngatcgacatg

SEQ ID NO: 4507 - DNA, 46 bp, Artificial Sequence
  Synthesized adaptor oligonucleotide
  misc_feature (34)..(36): n is a, c, g, or t
tgcaggaccagagaattcgaatacaaatgcctgnnngatcgacatg

SEQ ID NO: 4508 - DNA, 46 bp, Artificial Sequence
  Synthesized adaptor oligonucleotide
  misc_feature (34)..(36): n is a, c, g, or t
tgcaggaccagagaattcgaatacaccaggcacnnngatcgacatg

SEQ ID NO: 4509 - DNA, 46 bp, Artificial Sequence
  Synthesized adaptor oligonucleotide
  misc_feature (34)..(36): n is a, c, g, or t
tgcaggaccagagaattcgaatacatggcgaccnnntgcatcaggt

SEQ ID NO: 4510 - DNA, 46 bp, Artificial Sequence
  Synthesized adaptor oligonucleotide
  misc_feature (34)..(36): n is a, c, g, or t
tgcaggaccagagaattcgaatacaaagaggctnnntgcatcaggt

SEQ ID NO: 4511 - DNA, 46 bp, Artificial Sequence
  Synthesized adaptor oligonucleotide
  misc_feature (34)..(36): n is a, c, g, or t
tgcaggaccagagaattcgaatacattacccacnnntgcatcaggt

SEQ ID NO: 4512 - DNA, 46 bp, Artificial Sequence
  Synthesized adaptor oligonucleotide
  misc_feature (34)..(36): n is a, c, g, or t
tgcaggaccagagaattcgaatacatgcggattnnntgcatcaggt

SEQ ID NO: 4513 - DNA, 46 bp, Artificial Sequence
  Synthesized adaptor oligonucleotide
  misc_feature (34)..(36): n is a, c, g, or t
tgcaggaccagagaattcgaatacacaggttgtnnntgcatcaggt

SEQ ID NO: 4514 - DNA, 46 bp, Artificial Sequence
  Synthesized adaptor oligonucleotide
  misc_feature (34)..(36): n is a, c, g, or t
tgcaggaccagagaattcgaatacaaacatagannntgcatcaggt

SEQ ID NO: 4515 - DNA, 46 bp, Artificial Sequence
  Synthesized adaptor oligonucleotide
  misc_feature (34)..(36): n is a, c, g, or t
tgcaggaccagagaattcgaatacagaaatgatnnntgcatcaggt

SEQ ID NO: 4516 - DNA, 46 bp, Artificial Sequence
  Synthesized adaptor oligonucleotide
  misc_feature (34)..(36): n is a, c, g, or t
tgcaggaccagagaattcgaatacatgtgctgannntgcatcaggt

SEQ ID NO: 4517 - DNA, 46 bp, Artificial Sequence
  Synthesized adaptor oligonucleotide
  misc_feature (34)..(36): n is a, c, g, or t
tgcaggaccagagaattcgaatacaaggcagatnnntgcatcaggt

SEQ ID NO: 4518 - DNA, 46 bp, Artificial Sequence
  Synthesized adaptor oligonucleotide
  misc_feature (34)..(36): n is a, c, g, or t
tgcaggaccagagaattcgaatacataggttatnnntgcatcaggt

SEQ ID NO: 4519 - DNA, 46 bp, Artificial Sequence
  Synthesized adaptor oligonucleotide
  misc_feature (34)..(36): n is a, c, g, or t
tgcaggaccagagaattcgaatacatttttgtgnnntgcatcaggt

SEQ ID NO: 4520 - DNA, 46 bp, Artificial Sequence
  Synthesized adaptor oligonucleotide
  misc_feature (34)..(36): n is a, c, g, or t
tgcaggaccagagaattcgaatacaaaacaagtnnntgcatcaggt

SEQ ID NO: 4521 - DNA, 46 bp, Artificial Sequence
  Synthesized adaptor oligonucleotide
  misc_feature (34)..(36): n is a, c, g, or t
tgcaggaccagagaattcgaatacacgtggttannntgcatcaggt

SEQ ID NO: 4522 - DNA, 46 bp, Artificial Sequence
  Synthesized adaptor oligonucleotide
  misc_feature (34)..(36): n is a, c, g, or t
tgcaggaccagagaattcgaatacactttcgacnnntgcatcaggt

SEQ ID NO: 4523 - DNA, 46 bp, Artificial Sequence
  Synthesized adaptor oligonucleotide
  misc_feature (34)..(36): n is a, c, g, or t
tgcaggaccagagaattcgaatacatagacgtcnnntgcatcaggt

SEQ ID NO: 4524 - DNA, 46 bp, Artificial Sequence
  Synthesized adaptor oligonucleotide
  misc_feature (34)..(36): n is a, c, g, or t
tgcaggaccagagaattcgaatacatctagtccnnntgcatcaggt

SEQ ID NO: 4525 - DNA, 46 bp, Artificial Sequence
  Synthesized adaptor oligonucleotide
  misc_feature (34)..(36): n is a, c, g, or t
tgcaggaccagagaattcgaatacaaacaagatnnntgcatcaggt

SEQ ID NO: 4526 - DNA, 46 bp, Artificial Sequence
  Synthesized adaptor oligonucleotide
  misc_feature (34)..(36): n is a, c, g, or t
tgcaggaccagagaattcgaatacataatgaagnnntgcatcaggt

SEQ ID NO: 4527 - DNA, 46 bp, Artificial Sequence
  Synthesized adaptor oligonucleotide
  misc_feature (34)..(36): n is a, c, g, or t
tgcaggaccagagaattcgaatacatattcgccnnntgcatcaggt

SEQ ID NO: 4528 - DNA, 46 bp, Artificial Sequence
  Synthesized adaptor oligonucleotide
  misc_feature (34)..(36): n is a, c, g, or t
tgcaggaccagagaattcgaatacattgcacgannntgcatcaggt

SEQ ID NO: 4529 - DNA, 46 bp, Artificial Sequence
  Synthesized adaptor oligonucleotide
  misc_feature (34)..(36): n is a, c, g, or t
tgcaggaccagagaattcgaatacaactactaannntgcatcaggt

SEQ ID NO: 4530 - DNA, 46 bp, Artificial Sequence
  Synthesized adaptor oligonucleotide
  misc_feature (34)..(36): n is a, c, g, or t
tgcaggaccagagaattcgaatacaactcataannntgcatcaggt

SEQ ID NO: 4531 - DNA, 46 bp, Artificial Sequence
  Synthesized adaptor oligonucleotide
  misc_feature (34)..(36): n is a, c, g, or t
tgcaggaccagagaattcgaatacaaggactgannntgcatcaggt

SEQ ID NO: 4532 - DNA, 46 bp, Artificial Sequence
  Synthesized adaptor oligonucleotide
  misc_feature (34)..(36): n is a, c, g, or t
tgcaggaccagagaattcgaatacacacatcctnnntgcatcaggt

SEQ ID NO: 4533 - DNA, 46 bp, Artificial Sequence
  Synthesized adaptor oligonucleotide
  misc_feature (34)..(36): n is a, c, g, or t
tgcaggaccagagaattcgaatacaatagcgagnnntgcatcaggt

SEQ ID NO: 4534 - DNA, 46 bp, Artificial Sequence
  Synthesized adaptor oligonucleotide
  misc_feature (34)..(36): n is a, c, g, or t
tgcaggaccagagaattcgaatacaaggaagtcnnntgcatcaggt

SEQ ID NO: 4535 - DNA, 46 bp, Artificial Sequence
  Synthesized adaptor oligonucleotide
  misc_feature (34)..(36): n is a, c, g, or t
tgcaggaccagagaattcgaatacagaagccttnnntgcatcaggt

SEQ ID NO: 4536 - DNA, 46 bp, Artificial Sequence
  Synthesized adaptor oligonucleotide
  misc_feature (34)..(36): n is a, c, g, or t
tgcaggaccagagaattcgaatacacccccttcnnntgcatcaggt

SEQ ID NO: 4537 - DNA, 46 bp, Artificial Sequence
  Synthesized adaptor oligonucleotide
  misc_feature (34)..(36): n is a, c, g, or t
tgcaggaccagagaattcgaatacaagaaaccgnnntgcatcaggt

SEQ ID NO: 4538 - DNA, 46 bp, Artificial Sequence
  Synthesized adaptor oligonucleotide
  misc_feature (34)..(36): n is a, c, g, or t
tgcaggaccagagaattcgaatacagacatctgnnntgcatcaggt

SEQ ID NO: 4539 - DNA, 46 bp, Artificial Sequence
  Synthesized adaptor oligonucleotide
  misc_feature (34)..(36): n is a, c, g, or t
tgcaggaccagagaattcgaatacaacgccctcnnntgcatcaggt

SEQ ID NO: 4540 - DNA, 46 bp, Artificial Sequence
  Synthesized adaptor oligonucleotide
  misc_feature (34)..(36): n is a, c, g, or t
tgcaggaccagagaattcgaatacagtcaccggnnntgcatcaggt

SEQ ID NO: 4541 - DNA, 46 bp, Artificial Sequence
  Synthesized adaptor oligonucleotide
  misc_feature (34)..(36): n is a, c, g, or t
tgcaggaccagagaattcgaatacaagagcgatnnntgcatcaggt

SEQ ID NO: 4542 - DNA, 46 bp, Artificial Sequence
  Synthesized adaptor oligonucleotide
  misc_feature (34)..(36): n is a, c, g, or t
tgcaggaccagagaattcgaatacaatggcttgnnntgcatcaggt

SEQ ID NO: 4543 - DNA, 46 bp, Artificial Sequence
  Synthesized adaptor oligonucleotide
  misc_feature (34)..(36): n is a, c, g, or t
tgcaggaccagagaattcgaatacacctgcaaannntgcatcaggt

SEQ ID NO: 4544 - DNA, 46 bp, Artificial Sequence
  Synthesized adaptor oligonucleotide
  misc_feature (34)..(36): n is a, c, g, or t
tgcaggaccagagaattcgaatacagtcgaactnnntgcatcaggt

SEQ ID NO: 4545 - DNA, 46 bp, Artificial Sequence
  Synthesized adaptor oligonucleotide
  misc_feature (34)..(36): n is a, c, g, or t
tgcaggaccagagaattcgaatacatgtggagannntgcatcaggt

SEQ ID NO: 4546 - DNA, 46 bp, Artificial Sequence
  Synthesized adaptor oligonucleotide
  misc_feature (34)..(36): n is a, c, g, or t
tgcaggaccagagaattcgaatacaaacgtgctnnntgcatcaggt

SEQ ID NO: 4547 - DNA, 46 bp, Artificial Sequence
  Synthesized adaptor oligonucleotide
  misc_feature (34)..(36): n is a, c, g, or t
tgcaggaccagagaattcgaatacaaagattgannntgcatcaggt

SEQ ID NO: 4548 - DNA, 46 bp, Artificial Sequence
  Synthesized adaptor oligonucleotide
  misc_feature (34)..(36): n is a, c, g, or t
tgcaggaccagagaattcgaatacaacgttatannntgcatcaggt

SEQ ID NO: 4549 - DNA, 46 bp, Artificial Sequence
  Synthesized adaptor oligonucleotide
  misc_feature (34)..(36): n is a, c, g, or t
tgcaggaccagagaattcgaatacaccgcataannntgcatcaggt

SEQ ID NO: 4550 - DNA, 46 bp, Artificial Sequence
  Synthesized adaptor oligonucleotide
  misc_feature (34)..(36): n is a, c, g, or t
tgcaggaccagagaattcgaatacacgatttccnnntgcatcaggt

SEQ ID NO: 4551 - DNA, 46 bp, Artificial Sequence
  Synthesized adaptor oligonucleotide
  misc_feature (34)..(36): n is a, c, g, or t
tgcaggaccagagaattcgaatacagtaaaacannntgcatcaggt

SEQ ID NO: 4552 - DNA, 46 bp, Artificial Sequence
  Synthesized adaptor oligonucleotide
  misc_feature (34)..(36): n is a, c, g, or t
tgcaggaccagagaattcgaatacaggtggtccnnntgcatcaggt

SEQ ID NO: 4553 - DNA, 46 bp, Artificial Sequence
  Synthesized adaptor oligonucleotide
  misc_feature (34)..(36): n is a, c, g, or t
tgcaggaccagagaattcgaatacaatgtcgtgnnntgcatcaggt

SEQ ID NO: 4554 - DNA, 46 bp, Artificial Sequence
  Synthesized adaptor oligonucleotide
  misc_feature (34)..(36): n is a, c, g, or t
tgcaggaccagagaattcgaatacacgtaatatnnntgcatcaggt

SEQ ID NO: 4555 - DNA, 46 bp, Artificial Sequence
  Synthesized adaptor oligonucleotide
  misc_feature (34)..(36): n is a, c, g, or t
tgcaggaccagagaattcgaatacaactcgcttnnntgcatcaggt

SEQ ID NO: 4556 - DNA, 46 bp, Artificial Sequence
  Synthesized adaptor oligonucleotide
  misc_feature (34)..(36): n is a, c, g, or t
tgcaggaccagagaattcgaatacaccatacgannntgcatcaggt

SEQ ID NO: 4557 - DNA, 46 bp, Artificial Sequence
  Synthesized adaptor oligonucleotide
  misc_feature (34)..(36): n is a, c, g, or t
tgcaggaccagagaattcgaatacacggacaaannntgcatcaggt

SEQ ID NO: 4558 - DNA, 46 bp, Artificial Sequence
  Synthesized adaptor oligonucleotide
  misc_feature (34)..(36): n is a, c, g, or t
tgcaggaccagagaattcgaatacacgctgtttnnntgcatcaggt

SEQ ID NO: 4559 - DNA, 46 bp, Artificial Sequence
  Synthesized adaptor oligonucleotide
  misc_feature (34)..(36): n is a, c, g, or t
tgcaggaccagagaattcgaatacactcccatannntgcatcaggt

SEQ ID NO: 4560 - DNA, 46 bp, Artificial Sequence
  Synthesized adaptor oligonucleotide
  misc_feature (34)..(36): n is a, c, g, or t
tgcaggaccagagaattcgaatacaggcttgcgnnntgcatcaggt

SEQ ID NO: 4561 - DNA, 46 bp, Artificial Sequence
  Synthesized adaptor oligonucleotide
  misc_feature (34)..(36): n is a, c, g, or t
tgcaggaccagagaattcgaatacaaaatttcgnnntgcatcaggt

SEQ ID NO: 4562 - DNA, 46 bp, Artificial Sequence
  Synthesized adaptor oligonucleotide
  misc_feature (34)..(36): n is a, c, g, or t
tgcaggaccagagaattcgaatacatacctaggnnntgcatcaggt

SEQ ID NO: 4563 - DNA, 46 bp, Artificial Sequence
  Synthesized adaptor oligonucleotide
  misc_feature (34)..(36): n is a, c, g, or t
tgcaggaccagagaattcgaatacacacgcacgnnntgcatcaggt

SEQ ID NO: 4564 - DNA, 46 bp, Artificial Sequence
  Synthesized adaptor oligonucleotide
  misc_feature (34)..(36): n is a, c, g, or t
tgcaggaccagagaattcgaatacacattgcagnnntgcatcaggt

SEQ ID NO: 4565 - DNA, 46 bp, Artificial Sequence
  Synthesized adaptor oligonucleotide
  misc_feature (34)..(36): n is a, c, g, or t
tgcaggaccagagaattcgaatacagcattaatnnntgcatcaggt

SEQ ID NO: 4566 - DNA, 46 bp, Artificial Sequence
  Synthesized adaptor oligonucleotide
  misc_feature (34)..(36): n is a, c, g, or t
tgcaggaccagagaattcgaatacaagacgcccnnntgcatcaggt

SEQ ID NO: 4567 - DNA, 46 bp, Artificial Sequence
  Synthesized adaptor oligonucleotide
  misc_feature (34)..(36): n is a, c, g, or t
tgcaggaccagagaattcgaatacacacacgatnnntgcatcaggt

SEQ ID NO: 4568 - DNA, 46 bp, Artificial Sequence
  Synthesized adaptor oligonucleotide
  misc_feature (34)..(36): n is a, c, g, or t
tgcaggaccagagaattcgaatacatgattgtannntgcatcaggt

SEQ ID NO: 4569 - DNA, 46 bp, Artificial Sequence
  Synthesized adaptor oligonucleotide
  misc_feature (34)..(36): n is a, c, g, or t
tgcaggaccagagaattcgaatacatgttgtccnnnacgtatgcca

SEQ ID NO: 4570 - DNA, 46 bp, Artificial Sequence
  Synthesized adaptor oligonucleotide
  misc_feature (34)..(36): n is a, c, g, or t
tgcaggaccagagaattcgaatacataaccagcnnnacgtatgcca

SEQ ID NO: 4571 - DNA, 46 bp, Artificial Sequence
  Synthesized adaptor oligonucleotide
  misc_feature (34)..(36): n is a, c, g, or t
tgcaggaccagagaattcgaatacatgcgcgacnnnacgtatgcca

SEQ ID NO: 4572 - DNA, 46 bp, Artificial Sequence
  Synthesized adaptor oligonucleotide
  misc_feature (34)..(36): n is a, c, g, or t
tgcaggaccagagaattcgaatacaatcgtctcnnnacgtatgcca

SEQ ID NO: 4573 - DNA, 46 bp, Artificial Sequence
  Synthesized adaptor oligonucleotide
  misc_feature (34)..(36): n is a, c, g, or t
tgcaggaccagagaattcgaatacatccgcaccnnnacgtatgcca

SEQ ID NO: 4574 - DNA, 46 bp, Artificial Sequence
  Synthesized adaptor oligonucleotide
  misc_feature (34)..(36): n is a, c, g, or t
tgcaggaccagagaattcgaatacattactgaannnacgtatgcca

SEQ ID NO: 4575 - DNA, 46 bp, Artificial Sequence
  Synthesized adaptor oligonucleotide
  misc_feature (34)..(36): n is a, c, g, or t
tgcaggaccagagaattcgaatacaaggtccgcnnnacgtatgcca

SEQ ID NO: 4576 - DNA, 46 bp, Artificial Sequence
  Synthesized adaptor oligonucleotide
  misc_feature (34)..(36): n is a, c, g, or t
tgcaggaccagagaattcgaatacagtgccctcnnnacgtatgcca

SEQ ID NO: 4577 - DNA, 46 bp, Artificial Sequence
  Synthesized adaptor oligonucleotide
  misc_feature (34)..(36): n is a, c, g, or t
tgcaggaccagagaattcgaatacagcgtagccnnnacgtatgcca

SEQ ID NO: 4578 - DNA, 46 bp, Artificial Sequence
  Synthesized adaptor oligonucleotide
  misc_feature (34)..(36): n is a, c, g, or t
tgcaggaccagagaattcgaatacatagccaacnnnacgtatgcca

SEQ ID NO: 4579 - DNA, 46 bp, Artificial Sequence
  Synthesized adaptor oligonucleotide
  misc_feature (34)..(36): n is a, c, g, or t
tgcaggaccagagaattcgaatacaatataccannnacgtatgcca

SEQ ID NO: 4580 - DNA, 46 bp, Artificial Sequence
  Synthesized adaptor oligonucleotide
  misc_feature (34)..(36): n is a, c, g, or t
tgcaggaccagagaattcgaatacataaaatccnnnacgtatgcca

SEQ ID NO: 4581 - DNA, 46 bp, Artificial Sequence
  Synthesized adaptor oligonucleotide
  misc_feature (34)..(36): n is a, c, g, or t
tgcaggaccagagaattcgaatacagatggtgannnacgtatgcca

SEQ ID NO: 4582 - DNA, 46 bp, Artificial Sequence
  Synthesized adaptor oligonucleotide
  misc_feature (34)..(36): n is a, c, g, or t
tgcaggaccagagaattcgaatacagaacgtagnnnacgtatgcca

SEQ ID NO: 4583 - DNA, 46 bp, Artificial Sequence
  Synthesized adaptor oligonucleotide
  misc_feature (34)..(36): n is a, c, g, or t
tgcaggaccagagaattcgaatacaatattaatnnnacgtatgcca

SEQ ID NO: 4584 - DNA, 46 bp, Artificial Sequence
  Synthesized adaptor oligonucleotide
  misc_feature (34)..(36): n is a, c, g, or t
tgcaggaccagagaattcgaatacatactgaatnnnacgtatgcca

SEQ ID NO: 4585 - DNA, 46 bp, Artificial Sequence
  Synthesized adaptor oligonucleotide
  misc_feature (34)..(36): n is a, c, g, or t
tgcaggaccagagaattcgaatacagtccgagcnnnacgtatgcca

SEQ ID NO: 4586 - DNA, 46 bp, Artificial Sequence
  Synthesized adaptor oligonucleotide
  misc_feature (34)..(36): n is a, c, g, or t
tgcaggaccagagaattcgaatacacctggtaannnacgtatgcca

SEQ ID NO: 4587 - DNA, 46 bp, Artificial Sequence
  Synthesized adaptor oligonucleotide
  misc_feature (34)..(36): n is a, c, g, or t
tgcaggaccagagaattcgaatacaccctagaannnacgtatgcca

SEQ ID NO: 4588 - DNA, 46 bp, Artificial Sequence
  Synthesized adaptor oligonucleotide
  misc_feature (34)..(36): n is a, c, g, or t
tgcaggaccagagaattcgaatacattaaagtcnnnacgtatgcca

SEQ ID NO: 4589 - DNA, 46 bp, Artificial Sequence
  Synthesized adaptor oligonucleotide
  misc_feature (34)..(36): n is a, c, g, or t
tgcaggaccagagaattcgaatacaacgtggccnnnacgtatgcca

SEQ ID NO: 4590 - DNA, 46 bp, Artificial Sequence
  Synthesized adaptor oligonucleotide
  misc_feature (34)..(36): n is a, c, g, or t
tgcaggaccagagaattcgaatacagctatcctnnnacgtatgcca

SEQ ID NO: 4591 - DNA, 46 bp, Artificial Sequence
  Synthesized adaptor oligonucleotide
  misc_feature (34)..(36): n is a, c, g, or t
tgcaggaccagagaattcgaatacaagcgttgtnnnacgtatgcca

SEQ ID NO: 4592 - DNA, 46 bp, Artificial Sequence
  Synthesized adaptor oligonucleotide
  misc_feature (34)..(36): n is a, c, g, or t
tgcaggaccagagaattcgaatacacttcgctannnacgtatgcca

SEQ ID NO: 4593 - DNA, 46 bp, Artificial Sequence
  Synthesized adaptor oligonucleotide
  misc_feature (34)..(36): n is a, c, g, or t
tgcaggaccagagaattcgaatacacatttttgnnnacgtatgcca

SEQ ID NO: 4594 - DNA, 46 bp, Artificial Sequence
  Synthesized adaptor oligonucleotide
  misc_feature (34)..(36): n is a, c, g, or t
tgcaggaccagagaattcgaatacaaacttcggnnnacgtatgcca

SEQ ID NO: 4595 - DNA, 46 bp, Artificial Sequence
  Synthesized adaptor oligonucleotide
  misc_feature (34)..(36): n is a, c, g, or t
tgcaggaccagagaattcgaatacataccgtgannnacgtatgcca

SEQ ID NO: 4596 - DNA, 46 bp, Artificial Sequence
  Synthesized adaptor oligonucleotide
  misc_feature (34)..(36): n is a, c, g, or t
tgcaggaccagagaattcgaatacaagctttttnnnacgtatgcca

SEQ ID NO: 4597 - DNA, 46 bp, Artificial Sequence
  Synthesized adaptor oligonucleotide
  misc_feature (34)..(36): n is a, c, g, or t
tgcaggaccagagaattcgaatacatgttctcgnnnacgtatgcca

SEQ ID NO: 4598 - DNA, 46 bp, Artificial Sequence
  Synthesized adaptor oligonucleotide
  misc_feature (34)..(36): n is a, c, g, or t
tgcaggaccagagaattcgaatacaaatcggctnnnacgtatgcca

SEQ ID NO: 4599 - DNA, 46 bp, Artificial Sequence
  Synthesized adaptor oligonucleotide
  misc_feature (34)..(36): n is a, c, g, or t
tgcaggaccagagaattcgaatacatgaaccacnnnacgtatgcca

SEQ ID NO: 4600 - DNA, 46 bp, Artificial Sequence
  Synthesized adaptor oligonucleotide
  misc_feature (34)..(36): n is a, c, g, or t
tgcaggaccagagaattcgaatacaatttcatcnnnacgtatgcca

SEQ ID NO: 4601 - DNA, 46 bp, Artificial Sequence
  Synthesized adaptor oligonucleotide
  misc_feature (34)..(36): n is a, c, g, or t
tgcaggaccagagaattcgaatacacagtcacannnacgtatgcca

SEQ ID NO: 4602 - DNA, 46 bp, Artificial Sequence
  Synthesized adaptor oligonucleotide
  misc_feature (34)..(36): n is a, c, g, or t
tgcaggaccagagaattcgaatacacccatagannnacgtatgcca

SEQ ID NO: 4603 - DNA, 46 bp, Artificial Sequence
  Synthesized adaptor oligonucleotide
  misc_feature (34)..(36): n is a, c, g, or t
tgcaggaccagagaattcgaatacacagaatggnnnacgtatgcca

SEQ ID NO: 4604 - DNA, 46 bp, Artificial Sequence
  Synthesized adaptor oligonucleotide
  misc_feature (34)..(36): n is a, c, g, or t
tgcaggaccagagaattcgaatacagtatgaaannnacgtatgcca

SEQ ID NO: 4605 - DNA, 46 bp, Artificial Sequence
  Synthesized adaptor oligonucleotide
  misc_feature (34)..(36): n is a, c, g, or t
tgcaggaccagagaattcgaatacagtttaagtnnnacgtatgcca

SEQ ID NO: 4606 - DNA, 46 bp, Artificial Sequence
  Synthesized adaptor oligonucleotide
  misc_feature (34)..(36): n is a, c, g, or t
tgcaggaccagagaattcgaatacagcgttatgnnnacgtatgcca

SEQ ID NO: 4607 - DNA, 46 bp, Artificial Sequence
  Synthesized adaptor oligonucleotide
  misc_feature (34)..(36): n is a, c, g, or t
tgcaggaccagagaattcgaatacatccgttacnnnacgtatgcca

SEQ ID NO: 4608 - DNA, 46 bp, Artificial Sequence
  Synthesized adaptor oligonucleotide
  misc_feature (34)..(36): n is a, c, g, or t
tgcaggaccagagaattcgaatacacgaaacctnnnacgtatgcca

SEQ ID NO: 4609 - DNA, 46 bp, Artificial Sequence
  Synthesized adaptor oligonucleotide
  misc_feature (34)..(36): n is a, c, g, or t
tgcaggaccagagaattcgaatacacggccatgnnnacgtatgcca

SEQ ID NO: 4610 - DNA, 46 bp, Artificial Sequence
  Synthesized adaptor oligonucleotide
  misc_feature (34)..(36): n is a, c, g, or t
tgcaggaccagagaattcgaatacacgaaaagcnnnacgtatgcca

SEQ ID NO: 4611 - DNA, 46 bp, Artificial Sequence
  Synthesized adaptor oligonucleotide
  misc_feature (34)..(36): n is a, c, g, or t
tgcaggaccagagaattcgaatacaaggttgtcnnnacgtatgcca

SEQ ID NO: 4612 - DNA, 46 bp, Artificial Sequence
  Synthesized adaptor oligonucleotide
  misc_feature (34)..(36): n is a, c, g, or t
tgcaggaccagagaattcgaatacaacgaaggtnnnacgtatgcca

SEQ ID NO: 4613 - DNA, 46 bp, Artificial Sequence
  Synthesized adaptor oligonucleotide
  misc_feature (34)..(36): n is a, c, g, or t
tgcaggaccagagaattcgaatacatcccccgannnacgtatgcca

SEQ ID NO: 4614 - DNA, 46 bp, Artificial Sequence
  Synthesized adaptor oligonucleotide
  misc_feature (34)..(36): n is a, c, g, or t
tgcaggaccagagaattcgaatacaagcgatctnnnacgtatgcca

SEQ ID NO: 4615 - DNA, 46 bp, Artificial Sequence
  Synthesized adaptor oligonucleotide
  misc_feature (34)..(36): n is a, c, g, or t
tgcaggaccagagaattcgaatacactataatgnnnacgtatgcca

SEQ ID NO: 4616 - DNA, 46 bp, Artificial Sequence
  Synthesized adaptor oligonucleotide
  misc_feature (34)..(36): n is a, c, g, or t
tgcaggaccagagaattcgaatacattcgtctgnnnacgtatgcca

SEQ ID NO: 4617 - DNA, 46 bp, Artificial Sequence
  Synthesized adaptor oligonucleotide
  misc_feature (34)..(36): n is a, c, g, or t
tgcaggaccagagaattcgaatacagcgccttcnnnacgtatgcca

SEQ ID NO: 4618 - DNA, 46 bp, Artificial Sequence
  Synthesized adaptor oligonucleotide
  misc_feature (34)..(36): n is a, c, g, or t
tgcaggaccagagaattcgaatacacgcaatcannnacgtatgcca

SEQ ID NO: 4619 - DNA, 46 bp, Artificial Sequence
  Synthesized adaptor oligonucleotide
  misc_feature (34)..(36): n is a, c, g, or t
tgcaggaccagagaattcgaatacagtcggtcgnnnacgtatgcca

SEQ ID NO: 4620 - DNA, 46 bp, Artificial Sequence
  Synthesized adaptor oligonucleotide
  misc_feature (34)..(36): n is a, c, g, or t
tgcaggaccagagaattcgaatacatagcaggannnacgtatgcca

SEQ ID NO: 4621 - DNA, 46 bp, Artificial Sequence
  Synthesized adaptor oligonucleotide
  misc_feature (34)..(36): n is a, c, g, or t
tgcaggaccagagaattcgaatacagatggagtnnnacgtatgcca

SEQ ID NO: 4622 - DNA, 46 bp, Artificial Sequence
  Synthesized adaptor oligonucleotide
  misc_feature (34)..(36): n is a, c, g, or t
tgcaggaccagagaattcgaatacaaagcacctnnnacgtatgcca

SEQ ID NO: 4623 - DNA, 46 bp, Artificial Sequence
  Synthesized adaptor oligonucleotide
  misc_feature (34)..(36): n is a, c, g, or t
tgcaggaccagagaattcgaatacaagcggcctnnnacgtatgcca

SEQ ID NO: 4624 - DNA, 46 bp, Artificial Sequence
  Synthesized adaptor oligonucleotide
  misc_feature (34)..(36): n is a, c, g, or t
tgcaggaccagagaattcgaatacacgtttgctnnnacgtatgcca

SEQ ID NO: 4625 - DNA, 46 bp, Artificial Sequence
  Synthesized adaptor oligonucleotide
  misc_feature (34)..(36): n is a, c, g, or t
tgcaggaccagagaattcgaatacacctgcattnnnacgtatgcca

SEQ ID NO: 4626 - DNA, 46 bp, Artificial Sequence
  Synthesized adaptor oligonucleotide
  misc_feature (34)..(36): n is a, c, g, or t
tgcaggaccagagaattcgaatacaattgaatcnnnacgtatgcca

SEQ ID NO: 4627 - DNA, 46 bp, Artificial Sequence
  Synthesized adaptor oligonucleotide
  misc_feature (34)..(36): n is a, c, g, or t
tgcaggaccagagaattcgaatacatccgtgccnnnacgtatgcca

SEQ ID NO: 4628 - DNA, 46 bp, Artificial Sequence
  Synthesized adaptor oligonucleotide
  misc_feature (34)..(36): n is a, c, g, or t
tgcaggaccagagaattcgaatacatctcaggannnacgtatgcca

SEQ ID NO: 4629 - DNA, 46 bp, Artificial Sequence
  Synthesized adaptor oligonucleotide
  misc_feature (34)..(36): n is a, c, g, or t
tgcaggaccagagaattcgaatacaaagccgttnnnctagcgttac

SEQ ID NO: 4630 - DNA, 46 bp, Artificial Sequence
  Synthesized adaptor oligonucleotide
  misc_feature (34)..(36): n is a, c, g, or t
tgcaggaccagagaattcgaatacacaccctcgnnnctagcgttac

SEQ ID NO: 4631 - DNA, 46 bp, Artificial Sequence
  Synthesized adaptor oligonucleotide
  misc_feature (34)..(36): n is a, c, g, or t
tgcaggaccagagaattcgaatacagctagttgnnnctagcgttac

SEQ ID NO: 4632 - DNA, 46 bp, Artificial Sequence
  Synthesized adaptor oligonucleotide
  misc_feature (34)..(36): n is a, c, g, or t
tgcaggaccagagaattcgaatacaccgttactnnnctagcgttac

SEQ ID NO: 4633 - DNA, 46 bp, Artificial Sequence
  Synthesized adaptor oligonucleotide
  misc_feature (34)..(36): n is a, c, g, or t
tgcaggaccagagaattcgaatacataagcgtcnnnctagcgttac

SEQ ID NO: 4634 - DNA, 46 bp, Artificial Sequence
  Synthesized adaptor oligonucleotide
  misc_feature (34)..(36): n is a, c, g, or t
tgcaggaccagagaattcgaatacaggtaaacgnnnctagcgttac

SEQ ID NO: 4635 - DNA, 46 bp, Artificial Sequence
  Synthesized adaptor oligonucleotide
  misc_feature (34)..(36): n is a, c, g, or t
tgcaggaccagagaattcgaatacagaaccagannnctagcgttac

SEQ ID NO: 4636 - DNA, 46 bp, Artificial Sequence
  Synthesized adaptor oligonucleotide
  misc_feature (34)..(36): n is a, c, g, or t
tgcaggaccagagaattcgaatacaggactgttnnnctagcgttac

SEQ ID NO: 4637 - DNA, 46 bp, Artificial Sequence
  Synthesized adaptor oligonucleotide
  misc_feature (34)..(36): n is a, c, g, or t
tgcaggaccagagaattcgaatacaatcgtgtgnnnctagcgttac

SEQ ID NO: 4638 - DNA, 46 bp, Artificial Sequence
  Synthesized adaptor oligonucleotide
  misc_feature (34)..(36): n is a, c, g, or t
tgcaggaccagagaattcgaatacagtcacggcnnnctagcgttac

SEQ ID NO: 4639 - DNA, 46 bp, Artificial Sequence
  Synthesized adaptor oligonucleotide
  misc_feature (34)..(36): n is a, c, g, or t
tgcaggaccagagaattcgaatacatctcgtacnnnctagcgttac

SEQ ID NO: 4640 - DNA, 46 bp, Artificial Sequence
  Synthesized adaptor oligonucleotide
  misc_feature (34)..(36): n is a, c, g, or t
tgcaggaccagagaattcgaatacaagtcgcgcnnnctagcgttac

SEQ ID NO: 4641 - DNA, 46 bp, Artificial Sequence
  Synthesized adaptor oligonucleotide
  misc_feature (34)..(36): n is a, c, g, or t
tgcaggaccagagaattcgaatacacatagtcgnnnctagcgttac

SEQ ID NO: 4642 - DNA, 46 bp, Artificial Sequence
  Synthesized adaptor oligonucleotide
  misc_feature (34)..(36): n is a, c, g, or t
tgcaggaccagagaattcgaatacacatgtacgnnnctagcgttac

SEQ ID NO: 4643 - DNA, 46 bp, Artificial Sequence
  Synthesized adaptor oligonucleotide
  misc_feature (34)..(36): n is a, c, g, or t
tgcaggaccagagaattcgaatacagcgtatcannnctagcgttac

SEQ ID NO: 4644 - DNA, 46 bp, Artificial Sequence
  Synthesized adaptor oligonucleotide
  misc_feature (34)..(36): n is a, c, g, or t
tgcaggaccagagaattcgaatacacaattcttnnnctagcgttac

SEQ ID NO: 4645 - DNA, 46 bp, Artificial Sequence
  Synthesized adaptor oligonucleotide
  misc_feature (34)..(36): n is a, c, g, or t
tgcaggaccagagaattcgaatacaactctattnnnctagcgttac

SEQ ID NO: 4646 - DNA, 46 bp, Artificial Sequence
  Synthesized adaptor oligonucleotide
  misc_feature (34)..(36): n is a, c, g, or t
tgcaggaccagagaattcgaatacatcatcccannnctagcgttac

SEQ ID NO: 4647 - DNA, 46 bp, Artificial Sequence
  Synthesized adaptor oligonucleotide
  misc_feature (34)..(36): n is a, c, g, or t
tgcaggaccagagaattcgaatacaggcttggcnnnctagcgttac

SEQ ID NO: 4648 - DNA, 46 bp, Artificial Sequence
  Synthesized adaptor oligonucleotide
  misc_feature (34)..(36): n is a, c, g, or t
tgcaggaccagagaattcgaatacagttccttgnnnctagcgttac

SEQ ID NO: 4649 - DNA, 46 bp, Artificial Sequence
  Synthesized adaptor oligonucleotide
  misc_feature (34)..(36): n is a, c, g, or t
tgcaggaccagagaattcgaatacaatgagaatnnnctagcgttac

SEQ ID NO: 4650 - DNA, 46 bp, Artificial Sequence
  Synthesized adaptor oligonucleotide
  misc_feature (34)..(36): n is a, c, g, or t
tgcaggaccagagaattcgaatacactgtatccnnnctagcgttac

SEQ ID NO: 4651 - DNA, 46 bp, Artificial Sequence
  Synthesized adaptor oligonucleotide
  misc_feature (34)..(36): n is a, c, g, or t
tgcaggaccagagaattcgaatacatacgccccnnnctagcgttac

SEQ ID NO: 4652 - DNA, 46 bp, Artificial Sequence
  Synthesized adaptor oligonucleotide
  misc_feature (34)..(36): n is a, c, g, or t
tgcaggaccagagaattcgaatacatggccgacnnnctagcgttac

SEQ ID NO: 4653 - DNA, 46 bp, Artificial Sequence
  Synthesized adaptor oligonucleotide
  misc_feature (34)..(36): n is a, c, g, or t
tgcaggaccagagaattcgaatacaccgctgctnnnctagcgttac

SEQ ID NO: 4654 - DNA, 46 bp, Artificial Sequence
  Synthesized adaptor oligonucleotide
  misc_feature (34)..(36): n is a, c, g, or t
tgcaggaccagagaattcgaatacaggtagcccnnnctagcgttac

SEQ ID NO: 4655 - DNA, 46 bp, Artificial Sequence
  Synthesized adaptor oligonucleotide
  misc_feature (34)..(36): n is a, c, g, or t
tgcaggaccagagaattcgaatacatgacgttgnnnctagcgttac

SEQ ID NO: 4656 - DNA, 46 bp, Artificial Sequence
  Synthesized adaptor oligonucleotide
  misc_feature (34)..(36): n is a, c, g, or t
tgcaggaccagagaattcgaatacacccactatnnnctagcgttac

SEQ ID NO: 4657 - DNA, 46 bp, Artificial Sequence
  Synthesized adaptor oligonucleotide
  misc_feature (34)..(36): n is a, c, g, or t
tgcaggaccagagaattcgaatacaaagtgtaannnctagcgttac

SEQ ID NO: 4658 - DNA, 46 bp, Artificial Sequence
  Synthesized adaptor oligonucleotide
  misc_feature (34)..(36): n is a, c, g, or t
tgcaggaccagagaattcgaatacaggagtatgnnnctagcgttac

SEQ ID NO: 4659 - DNA, 46 bp, Artificial Sequence
  Synthesized adaptor oligonucleotide
  misc_feature (34)..(36): n is a, c, g, or t
tgcaggaccagagaattcgaatacaagtgataannnctagcgttac

SEQ ID NO: 4660 - DNA, 46 bp, Artificial Sequence
  Synthesized adaptor oligonucleotide
  misc_feature (34)..(36): n is a, c, g, or t
tgcaggaccagagaattcgaatacataattcgannnctagcgttac

SEQ ID NO: 4661 - DNA, 46 bp, Artificial Sequence
  Synthesized adaptor oligonucleotide
  misc_feature (34)..(36): n is a, c, g, or t
tgcaggaccagagaattcgaatacaagctttggnnnctagcgttac

SEQ ID NO: 4662 - DNA, 46 bp, Artificial Sequence
  Synthesized adaptor oligonucleotide
  misc_feature (34)..(36): n is a, c, g, or t
tgcaggaccagagaattcgaatacaacatgtcgnnnctagcgttac

SEQ ID NO: 4663 - DNA, 46 bp, Artificial Sequence
  Synthesized adaptor oligonucleotide
  misc_feature (34)..(36): n is a, c, g, or t
tgcaggaccagagaattcgaatacatcagcgcgnnnctagcgttac

SEQ ID NO: 4664 - DNA, 46 bp, Artificial Sequence
  Synthesized adaptor oligonucleotide
  misc_feature (34)..(36): n is a, c, g, or t
tgcaggaccagagaattcgaatacagcccggtannnctagcgttac

SEQ ID NO: 4665 - DNA, 46 bp, Artificial Sequence
  Synthesized adaptor oligonucleotide
  misc_feature (34)..(36): n is a, c, g, or t
tgcaggaccagagaattcgaatacaccattcacnnnctagcgttac

SEQ ID NO: 4666 - DNA, 46 bp, Artificial Sequence
  Synthesized adaptor oligonucleotide
  misc_feature (34)..(36): n is a, c, g, or t
tgcaggaccagagaattcgaatacattccccttnnnctagcgttac

SEQ ID NO: 4667 - DNA, 46 bp, Artificial Sequence
  Synthesized adaptor oligonucleotide
  misc_feature (34)..(36): n is a, c, g, or t
tgcaggaccagagaattcgaatacaaccctccgnnnctagcgttac

SEQ ID NO: 4668 - DNA, 46 bp, Artificial Sequence
  Synthesized adaptor oligonucleotide
  misc_feature (34)..(36): n is a, c, g, or t
tgcaggaccagagaattcgaatacacaccttacnnnctagcgttac

SEQ ID NO: 4669 - DNA, 46 bp, Artificial Sequence
  Synthesized adaptor oligonucleotide
  misc_feature (34)..(36): n is a, c, g, or t
tgcaggaccagagaattcgaatacaggagttgannnctagcgttac

SEQ ID NO: 4670 - DNA, 46 bp, Artificial Sequence
  Synthesized adaptor oligonucleotide
  misc_feature (34)..(36): n is a, c, g, or t
tgcaggaccagagaattcgaatacagacaagacnnnctagcgttac

SEQ ID NO: 4671 - DNA, 46 bp, Artificial Sequence
  Synthesized adaptor oligonucleotide
  misc_feature (34)..(36): n is a, c, g, or t
tgcaggaccagagaattcgaatacagtctacgannnctagcgttac

SEQ ID NO: 4672 - DNA, 46 bp, Artificial Sequence
  Synthesized adaptor oligonucleotide
  misc_feature (34)..(36): n is a, c, g, or t
tgcaggaccagagaattcgaatacatcgctcatnnnctagcgttac

SEQ ID NO: 4673 - DNA, 46 bp, Artificial Sequence
  Synthesized adaptor oligonucleotide
  misc_feature (34)..(36): n is a, c, g, or t
tgcaggaccagagaattcgaatacaccaagccgnnnctagcgttac

SEQ ID NO: 4674 - DNA, 46 bp, Artificial Sequence
  Synthesized adaptor oligonucleotide
  misc_feature (34)..(36): n is a, c, g, or t
tgcaggaccagagaattcgaatacaccctcggtnnnctagcgttac

SEQ ID NO: 4675 - DNA, 46 bp, Artificial Sequence
  Synthesized adaptor oligonucleotide
  misc_feature (34)..(36): n is a, c, g, or t
tgcaggaccagagaattcgaatacaaactagttnnnctagcgttac

SEQ ID NO: 4676 - DNA, 46 bp, Artificial Sequence
  Synthesized adaptor oligonucleotide
  misc_feature (34)..(36): n is a, c, g, or t
tgcaggaccagagaattcgaatacagagtgagtnnnctagcgttac

SEQ ID NO: 4677 - DNA, 46 bp, Artificial Sequence
  Synthesized adaptor oligonucleotide
  misc_feature (34)..(36): n is a, c, g, or t
tgcaggaccagagaattcgaatacacaatactannnctagcgttac

SEQ ID NO: 4678 - DNA, 46 bp, Artificial Sequence
  Synthesized adaptor oligonucleotide
  misc_feature (34)..(36): n is a, c, g, or t
tgcaggaccagagaattcgaatacacctttggtnnnctagcgttac

SEQ ID NO: 4679 - DNA, 46 bp, Artificial Sequence
  Synthesized adaptor oligonucleotide
  misc_feature (34)..(36): n is a, c, g, or t
tgcaggaccagagaattcgaatacattcacaccnnnctagcgttac

SEQ ID NO: 4680 - DNA, 46 bp, Artificial Sequence
  Synthesized adaptor oligonucleotide
  misc_feature (34)..(36): n is a, c, g, or t
tgcaggaccagagaattcgaatacagttatcccnnnctagcgttac

SEQ ID NO: 4681 - DNA, 46 bp, Artificial Sequence
  Synthesized adaptor oligonucleotide
  misc_feature (34)..(36): n is a, c, g, or t
tgcaggaccagagaattcgaatacaaaacttgtnnnctagcgttac

SEQ ID NO: 4682 - DNA, 46 bp, Artificial Sequence
  Synthesized adaptor oligonucleotide
  misc_feature (34)..(36): n is a, c, g, or t
tgcaggaccagagaattcgaatacacaacccaannnctagcgttac

SEQ ID NO: 4683 - DNA, 46 bp, Artificial Sequence
  Synthesized adaptor oligonucleotide
  misc_feature (34)..(36): n is a, c, g, or t
tgcaggaccagagaattcgaatacagttcacgannnctagcgttac

SEQ ID NO: 4684 - DNA, 46 bp, Artificial Sequence
  Synthesized adaptor oligonucleotide
  misc_feature (34)..(36): n is a, c, g, or t
tgcaggaccagagaattcgaatacacgtctactnnnctagcgttac

SEQ ID NO: 4685 - DNA, 46 bp, Artificial Sequence
  Synthesized adaptor oligonucleotide
  misc_feature (34)..(36): n is a, c, g, or t
tgcaggaccagagaattcgaatacatcaacagcnnnctagcgttac

SEQ ID NO: 4686 - DNA, 46 bp, Artificial Sequence
  Synthesized adaptor oligonucleotide
  misc_feature (34)..(36): n is a, c, g, or t
tgcaggaccagagaattcgaatacattgagtcgnnnctagcgttac

SEQ ID NO: 4687 - DNA, 46 bp, Artificial Sequence
  Synthesized adaptor oligonucleotide
  misc_feature (34)..(36): n is a, c, g, or t
tgcaggaccagagaattcgaatacagcatctgannnctagcgttac

SEQ ID NO: 4688 - DNA, 46 bp, Artificial Sequence
  Synthesized adaptor oligonucleotide
  misc_feature (34)..(36): n is a, c, g, or t
tgcaggaccagagaattcgaatacatggcagttnnnctagcgttac

SEQ ID NO: 4689 - DNA, 46 bp, Artificial Sequence
  Synthesized adaptor oligonucleotide
  misc_feature (34)..(36): n is a, c, g, or t
tgcaggaccagagaattcgaatacagatctctcnnngatcgacatg

SEQ ID NO: 4690 - DNA, 46 bp, Artificial Sequence
  Synthesized adaptor oligonucleotide
  misc_feature (34)..(36): n is a, c, g, or t
tgcaggaccagagaattcgaatacagagcgcgannngatcgacatg

SEQ ID NO: 4691 - DNA, 46 bp, Artificial Sequence
  Synthesized adaptor oligonucleotide
  misc_feature (34)..(36): n is a, c, g, or t
tgcaggaccagagaattcgaatacactctctagnnngatcgacatg

SEQ ID NO: 4692 - DNA, 46 bp, Artificial Sequence
  Synthesized adaptor oligonucleotide
  misc_feature (34)..(36): n is a, c, g, or t
tgcaggaccagagaattcgaatacacgtggcgtnnngatcgacatg

SEQ ID NO: 4693 - DNA, 46 bp, Artificial Sequence
  Synthesized adaptor oligonucleotide
  misc_feature (34)..(36): n is a, c, g, or t
tgcaggaccagagaattcgaatacaagctagtcnnngatcgacatg

SEQ ID NO: 4694 - DNA, 46 bp, Artificial Sequence
  Synthesized adaptor oligonucleotide
  misc_feature (34)..(36): n is a, c, g, or t
tgcaggaccagagaattcgaatacagctatgtgnnngatcgacatg

SEQ ID NO: 4695 - DNA, 46 bp, Artificial Sequence
  Synthesized adaptor oligonucleotide
  misc_feature (34)..(36): n is a, c, g, or t
tgcaggaccagagaattcgaatacatctgcttgnnngatcgacatg

SEQ ID NO: 4696 - DNA, 46 bp, Artificial Sequence
  Synthesized adaptor oligonucleotide
  misc_feature (34)..(36): n is a, c, g, or t
tgcaggaccagagaattcgaatacagtacgctannngatcgacatg

SEQ ID NO: 4697 - DNA, 46 bp, Artificial Sequence
  Synthesized adaptor oligonucleotide
  misc_feature (34)..(36): n is a, c, g, or t
tgcaggaccagagaattcgaatacagacccgtgnnngatcgacatg

SEQ ID NO: 4698 - DNA, 46 bp, Artificial Sequence
  Synthesized adaptor oligonucleotide
  misc_feature (34)..(36): n is a, c, g, or t
tgcaggaccagagaattcgaatacagtcatgacnnngatcgacatg

SEQ ID NO: 4699 - DNA, 46 bp, Artificial Sequence
  Synthesized adaptor oligonucleotide
  misc_feature (34)..(36): n is a, c, g, or t
tgcaggaccagagaattcgaatacacgctagatnnngatcgacatg

SEQ ID NO: 4700 - DNA, 46 bp, Artificial Sequence
  Synthesized adaptor oligonucleotide
  misc_feature (34)..(36): n is a, c, g, or t
tgcaggaccagagaattcgaatacagtaatgaannngatcgacatg

SEQ ID NO: 4701 - DNA, 46 bp, Artificial Sequence
  Synthesized adaptor oligonucleotide
  misc_feature (34)..(36): n is a, c, g, or t
tgcaggaccagagaattcgaatacatcgtatttnnngatcgacatg

SEQ ID NO: 4702 - DNA, 46 bp, Artificial Sequence
  Synthesized adaptor oligonucleotide
  misc_feature (34)..(36): n is a, c, g, or t
tgcaggaccagagaattcgaatacacacgtacannngatcgacatg

SEQ ID NO: 4703 - DNA, 46 bp, Artificial Sequence
  Synthesized adaptor oligonucleotide
  misc_feature (34)..(36): n is a, c, g, or t
tgcaggaccagagaattcgaatacatgactaatnnngatcgacatg

SEQ ID NO: 4704 - DNA, 46 bp, Artificial Sequence
  Synthesized adaptor oligonucleotide
  misc_feature (34)..(36): n is a, c, g, or t
tgcaggaccagagaattcgaatacactaccgccnnngatcgacatg

SEQ ID NO: 4705 - DNA, 46 bp, Artificial Sequence
  Synthesized adaptor oligonucleotide
  misc_feature (34)..(36): n is a, c, g, or t
tgcaggaccagagaattcgaatacaggcacttannngatcgacatg

SEQ ID NO: 4706 - DNA, 46 bp, Artificial Sequence
  Synthesized adaptor oligonucleotide
  misc_feature (34)..(36): n is a, c, g, or t
tgcaggaccagagaattcgaatacatccttagcnnngatcgacatg

SEQ ID NO: 4707 - DNA, 46 bp, Artificial Sequence
  Synthesized adaptor oligonucleotide
  misc_feature (34)..(36): n is a, c, g, or t
tgcaggaccagagaattcgaatacagctatagcnnngatcgacatg

SEQ ID NO: 4708 - DNA, 46 bp, Artificial Sequence
  Synthesized adaptor oligonucleotide
  misc_feature (34)..(36): n is a, c, g, or t
tgcaggaccagagaattcgaatacaaatgaacannngatcgacatg

SEQ ID NO: 4709 - DNA, 46 bp, Artificial Sequence
  Synthesized adaptor oligonucleotide
  misc_feature (34)..(36): n is a, c, g, or t
tgcaggaccagagaattcgaatacagtagtaaannngatcgacatg

SEQ ID NO: 4710 - DNA, 46 bp, Artificial Sequence
  Synthesized adaptor oligonucleotide
  misc_feature (34)..(36): n is a, c, g, or t
tgcaggaccagagaattcgaatacatagttcggnnngatcgacatg

SEQ ID NO: 4711 - DNA, 46 bp, Artificial Sequence
  Synthesized adaptor oligonucleotide
  misc_feature (34)..(36): n is a, c, g, or t
tgcaggaccagagaattcgaatacagttgtgacnnngatcgacatg

SEQ ID NO: 4712 - DNA, 46 bp, Artificial Sequence
  Synthesized adaptor oligonucleotide
  misc_feature (34)..(36): n is a, c, g, or t
tgcaggaccagagaattcgaatacacgcgtagcnnngatcgacatg

SEQ ID NO: 4713 - DNA, 46 bp, Artificial Sequence
  Synthesized adaptor oligonucleotide
  misc_feature (34)..(36): n is a, c, g, or t
tgcaggaccagagaattcgaatacactatgtggnnngatcgacatg

SEQ ID NO: 4714 - DNA, 46 bp, Artificial Sequence
  Synthesized adaptor oligonucleotide
  misc_feature (34)..(36): n is a, c, g, or t
tgcaggaccagagaattcgaatacattggcgtannngatcgacatg

SEQ ID NO: 4715 - DNA, 46 bp, Artificial Sequence
  Synthesized adaptor oligonucleotide
  misc_feature (34)..(36): n is a, c, g, or t
tgcaggaccagagaattcgaatacaattatcctnnngatcgacatg

SEQ ID NO: 4716 - DNA, 46 bp, Artificial Sequence
  Synthesized adaptor oligonucleotide
  misc_feature (34)..(36): n is a, c, g, or t
tgcaggaccagagaattcgaatacactttgaaannngatcgacatg

SEQ ID NO: 4717 - DNA, 46 bp, Artificial Sequence
  Synthesized adaptor oligonucleotide
  misc_feature (34)..(36): n is a, c, g, or t
tgcaggaccagagaattcgaatacactagtacgnnngatcgacatg

SEQ ID NO: 4718 - DNA, 46 bp, Artificial Sequence
  Synthesized adaptor oligonucleotide
  misc_feature (34)..(36): n is a, c, g, or t
tgcaggaccagagaattcgaatacatcccacatnnngatcgacatg

SEQ ID NO: 4719 - DNA, 46 bp, Artificial Sequence
  Synthesized adaptor oligonucleotide
  misc_feature (34)..(36): n is a, c, g, or t
tgcaggaccagagaattcgaatacagtatcgacnnngatcgacatg

SEQ ID NO: 4720 - DNA, 46 bp, Artificial Sequence
  Synthesized adaptor oligonucleotide
  misc_feature (34)..(36): n is a, c, g, or t
tgcaggaccagagaattcgaatacaggcctcagnnngatcgacatg

SEQ ID NO: 4721 - DNA, 46 bp, Artificial Sequence
  Synthesized adaptor oligonucleotide
  misc_feature (34)..(36): n is a, c, g, or t
tgcaggaccagagaattcgaatacacggcttaannngatcgacatg

SEQ ID NO: 4722 - DNA, 46 bp, Artificial Sequence
  Synthesized adaptor oligonucleotide
  misc_feature (34)..(36): n is a, c, g, or t
tgcaggaccagagaattcgaatacacatagcacnnngatcgacatg

SEQ ID NO: 4723 - DNA, 46 bp, Artificial Sequence
  Synthesized adaptor oligonucleotide
  misc_feature (34)..(36): n is a, c, g, or t
tgcaggaccagagaattcgaatacaccactttgnnngatcgacatg

SEQ ID NO: 4724 - DNA, 46 bp, Artificial Sequence
  Synthesized adaptor oligonucleotide
  misc_feature (34)..(36): n is a, c, g, or t
tgcaggaccagagaattcgaatacatgtgatgcnnngatcgacatg

SEQ ID NO: 4725 - DNA, 46 bp, Artificial Sequence
  Synthesized adaptor oligonucleotide
  misc_feature (34)..(36): n is a, c, g, or t
tgcaggaccagagaattcgaatacaatcgctagnnngatcgacatg

SEQ ID NO: 4726 - DNA, 46 bp, Artificial Sequence
  Synthesized adaptor oligonucleotide
  misc_feature (34)..(36): n is a, c, g, or t
tgcaggaccagagaattcgaatacagaattagannngatcgacatg

SEQ ID NO: 4727 - DNA, 46 bp, Artificial Sequence
  Synthesized adaptor oligonucleotide
  misc_feature (34)..(36): n is a, c, g, or t
tgcaggaccagagaattcgaatacagcggtcgtnnngatcgacatg

SEQ ID NO: 4728 - DNA, 46 bp, Artificial Sequence
  Synthesized adaptor oligonucleotide
  misc_feature (34)..(36): n is a, c, g, or t
tgcaggaccagagaattcgaatacaaattgcatnnngatcgacatg

SEQ ID NO: 4729 - DNA, 46 bp, Artificial Sequence
  Synthesized adaptor oligonucleotide
  misc_feature (34)..(36): n is a, c, g, or t
tgcaggaccagagaattcgaatacatggaacctnnngatcgacatg

SEQ ID NO: 4730 - DNA, 46 bp, Artificial Sequence
  Synthesized adaptor oligonucleotide
  misc_feature (34)..(36): n is a, c, g, or t
tgcaggaccagagaattcgaatacaagcgcattnnngatcgacatg

SEQ ID NO: 4731 - DNA, 46 bp, Artificial Sequence
  Synthesized adaptor oligonucleotide
  misc_feature (34)..(36): n is a, c, g, or t
tgcaggaccagagaattcgaatacattccctctnnngatcgacatg

SEQ ID NO: 4732 - DNA, 46 bp, Artificial Sequence
  Synthesized adaptor oligonucleotide
  misc_feature (34)..(36): n is a, c, g, or t
tgcaggaccagagaattcgaatacaattgtcggnnngatcgacatg

SEQ ID NO: 4733 - DNA, 46 bp, Artificial Sequence
  Synthesized adaptor oligonucleotide
  misc_feature (34)..(36): n is a, c, g, or t
tgcaggaccagagaattcgaatacataatgcgcnnngatcgacatg

SEQ ID NO: 4734 - DNA, 46 bp, Artificial Sequence
  Synthesized adaptor oligonucleotide
  misc_feature (34)..(36): n is a, c, g, or t
tgcaggaccagagaattcgaatacaacgcattgnnngatcgacatg

SEQ ID NO: 4735 - DNA, 46 bp, Artificial Sequence
  Synthesized adaptor oligonucleotide
  misc_feature (34)..(36): n is a, c, g, or t
tgcaggaccagagaattcgaatacatgtcggtannngatcgacatg

SEQ ID NO: 4736 - DNA, 46 bp, Artificial Sequence
  Synthesized adaptor oligonucleotide
  misc_feature (34)..(36): n is a, c, g, or t
tgcaggaccagagaattcgaatacattttcaacnnngatcgacatg

SEQ ID NO: 4737 - DNA, 46 bp, Artificial Sequence
  Synthesized adaptor oligonucleotide
  misc_feature (34)..(36): n is a, c, g, or t
tgcaggaccagagaattcgaatacataagtactnnngatcgacatg

SEQ ID NO: 4738 - DNA, 46 bp, Artificial Sequence
  Synthesized adaptor oligonucleotide
  misc_feature (34)..(36): n is a, c, g, or t
tgcaggaccagagaattcgaatacaaattagtcnnngatcgacatg

SEQ ID NO: 4739 - DNA, 46 bp, Artificial Sequence
  Synthesized adaptor oligonucleotide
  misc_feature (34)..(36): n is a, c, g, or t
tgcaggaccagagaattcgaatacaggaaatatnnngatcgacatg

SEQ ID NO: 4740 - DNA, 46 bp, Artificial Sequence
  Synthesized adaptor oligonucleotide
  misc_feature (34)..(36): n is a, c, g, or t
tgcaggaccagagaattcgaatacattttttaannngatcgacatg

SEQ ID NO: 4741 - DNA, 46 bp, Artificial Sequence
  Synthesized adaptor oligonucleotide
  misc_feature (34)..(36): n is a, c, g, or t
tgcaggaccagagaattcgaatacacacgtaacnnngatcgacatg

SEQ ID NO: 4742 - DNA, 46 bp, Artificial Sequence
  Synthesized adaptor oligonucleotide
  misc_feature (34)..(36): n is a, c, g, or t
tgcaggaccagagaattcgaatacagtttccgtnnngatcgacatg

SEQ ID NO: 4743 - DNA, 46 bp, Artificial Sequence
  Synthesized adaptor oligonucleotide
  misc_feature (34)..(36): n is a, c, g, or t
tgcaggaccagagaattcgaatacaagtatctannngatcgacatg

SEQ ID NO: 4744 - DNA, 46 bp, Artificial Sequence
  Synthesized adaptor oligonucleotide
  misc_feature (34)..(36): n is a, c, g, or t
tgcaggaccagagaattcgaatacatctagtggnnngatcgacatg

SEQ ID NO: 4745 - DNA, 46 bp, Artificial Sequence
  Synthesized adaptor oligonucleotide
  misc_feature (34)..(36): n is a, c, g, or t
tgcaggaccagagaattcgaatacagagtacagnnngatcgacatg

SEQ ID NO: 4746 - DNA, 46 bp, Artificial Sequence
  Synthesized adaptor oligonucleotide
  misc_feature (34)..(36): n is a, c, g, or t
tgcaggaccagagaattcgaatacaactccagannngatcgacatg

SEQ ID NO: 4747 - DNA, 46 bp, Artificial Sequence
  Synthesized adaptor oligonucleotide
  misc_feature (34)..(36): n is a, c, g, or t
tgcaggaccagagaattcgaatacaaaacacaannngatcgacatg

SEQ ID NO: 4748 - DNA, 46 bp, Artificial Sequence
  Synthesized adaptor oligonucleotide
  misc_feature (34)..(36): n is a, c, g, or t
tgcaggaccagagaattcgaatacagccgcaacnnngatcgacatg

SEQ ID NO: 4749 - DNA, 46 bp, Artificial Sequence
  Synthesized adaptor oligonucleotide
  misc_feature (34)..(36): n is a, c, g, or t
tgcaggaccagagaattcgaatacagatcttaannntgcatcaggt

SEQ ID NO: 4750 - DNA, 46 bp, Artificial Sequence
  Synthesized adaptor oligonucleotide
  misc_feature (34)..(36): n is a, c, g, or t
tgcaggaccagagaattcgaatacactagagtcnnntgcatcaggt

SEQ ID NO: 4751 - DNA, 46 bp, Artificial Sequence
  Synthesized adaptor oligonucleotide
  misc_feature (34)..(36): n is a, c, g, or t
tgcaggaccagagaattcgaatacagcattctcnnntgcatcaggt

SEQ ID NO: 4752 - DNA, 46 bp, Artificial Sequence
  Synthesized adaptor oligonucleotide
  misc_feature (34)..(36): n is a, c, g, or t
tgcaggaccagagaattcgaatacagcagccacnnntgcatcaggt

SEQ ID NO: 4753 - DNA, 46 bp, Artificial Sequence
  Synthesized adaptor oligonucleotide
  misc_feature (34)..(36): n is a, c, g, or t
tgcaggaccagagaattcgaatacaagctgcgcnnntgcatcaggt

SEQ ID NO: 4754 - DNA, 46 bp, Artificial Sequence
  Synthesized adaptor oligonucleotide
  misc_feature (34)..(36): n is a, c, g, or t
tgcaggaccagagaattcgaatacacccgctacnnntgcatcaggt

SEQ ID NO: 4755 - DNA, 46 bp, Artificial Sequence
  Synthesized adaptor oligonucleotide
  misc_feature (34)..(36): n is a, c, g, or t
tgcaggaccagagaattcgaatacacaaggcaannntgcatcaggt

SEQ ID NO: 4756 - DNA, 46 bp, Artificial Sequence
  Synthesized adaptor oligonucleotide
  misc_feature (34)..(36): n is a, c, g, or t
tgcaggaccagagaattcgaatacagatgttatnnntgcatcaggt

SEQ ID NO: 4757 - DNA, 46 bp, Artificial Sequence
  Synthesized adaptor oligonucleotide
  misc_feature (34)..(36): n is a, c, g, or t
tgcaggaccagagaattcgaatacacggtattgnnntgcatcaggt

SEQ ID NO: 4758 - DNA, 46 bp, Artificial Sequence
  Synthesized adaptor oligonucleotide
  misc_feature (34)..(36): n is a, c, g, or t
tgcaggaccagagaattcgaatacagtatttagnnntgcatcaggt

SEQ ID NO: 4759 - DNA, 46 bp, Artificial Sequence
  Synthesized adaptor oligonucleotide
  misc_feature (34)..(36): n is a, c, g, or t
tgcaggaccagagaattcgaatacaggatcagannntgcatcaggt

SEQ ID NO: 4760 - DNA, 46 bp, Artificial Sequence
  Synthesized adaptor oligonucleotide
  misc_feature (34)..(36): n is a, c, g, or t
tgcaggaccagagaattcgaatacaatcgaaaannntgcatcaggt

SEQ ID NO: 4761 - DNA, 46 bp, Artificial Sequence
  Synthesized adaptor oligonucleotide
  misc_feature (34)..(36): n is a, c, g, or t
tgcaggaccagagaattcgaatacagccatttcnnntgcatcaggt

SEQ ID NO: 4762 - DNA, 46 bp, Artificial Sequence
  Synthesized adaptor oligonucleotide
  misc_feature (34)..(36): n is a, c, g, or t
tgcaggaccagagaattcgaatacatcagaccannntgcatcaggt

SEQ ID NO: 4763 - DNA, 46 bp, Artificial Sequence
  Synthesized adaptor oligonucleotide
  misc_feature (34)..(36): n is a, c, g, or t
tgcaggaccagagaattcgaatacatttgttcannntgcatcaggt

SEQ ID NO: 4764 - DNA, 46 bp, Artificial Sequence
  Synthesized adaptor oligonucleotide
  misc_feature (34)..(36): n is a, c, g, or t
tgcaggaccagagaattcgaatacaaccctatcnnntgcatcaggt

SEQ ID NO: 4765 - DNA, 46 bp, Artificial Sequence
  Synthesized adaptor oligonucleotide
  misc_feature (34)..(36): n is a, c, g, or t
tgcaggaccagagaattcgaatacaaaaagccgnnntgcatcaggt

SEQ ID NO: 4766 - DNA, 46 bp, Artificial Sequence
  Synthesized adaptor oligonucleotide
  misc_feature (34)..(36): n is a, c, g, or t
tgcaggaccagagaattcgaatacagagtgcggnnntgcatcaggt

SEQ ID NO: 4767 - DNA, 46 bp, Artificial Sequence
  Synthesized adaptor oligonucleotide
  misc_feature (34)..(36): n is a, c, g, or t
tgcaggaccagagaattcgaatacaatcatacannntgcatcaggt

SEQ ID NO: 4768 - DNA, 46 bp, Artificial Sequence
  Synthesized adaptor oligonucleotide
  misc_feature (34)..(36): n is a, c, g, or t
tgcaggaccagagaattcgaatacacagatgagnnntgcatcaggt

SEQ ID NO: 4769 - DNA, 46 bp, Artificial Sequence
  Synthesized adaptor oligonucleotide
  misc_feature (34)..(36): n is a, c, g, or t
tgcaggaccagagaattcgaatacacagcttagnnntgcatcaggt

SEQ ID NO: 4770 - DNA, 46 bp, Artificial Sequence
  Synthesized adaptor oligonucleotide
  misc_feature (34)..(36): n is a, c, g, or t
tgcaggaccagagaattcgaatacaacttcttannntgcatcaggt

SEQ ID NO: 4771 - DNA, 46 bp, Artificial Sequence
  Synthesized adaptor oligonucleotide
  misc_feature (34)..(36): n is a, c, g, or t
tgcaggaccagagaattcgaatacacaacagagnnntgcatcaggt

SEQ ID NO: 4772 - DNA, 46 bp, Artificial Sequence
  Synthesized adaptor oligonucleotide
  misc_feature (34)..(36): n is a, c, g, or t
tgcaggaccagagaattcgaatacacgtagatcnnntgcatcaggt

SEQ ID NO: 4773 - DNA, 46 bp, Artificial Sequence
  Synthesized adaptor oligonucleotide
  misc_feature (34)..(36): n is a, c, g, or t
tgcaggaccagagaattcgaatacacctcccgannntgcatcaggt

SEQ ID NO: 4774 - DNA, 46 bp, Artificial Sequence
  Synthesized adaptor oligonucleotide
  misc_feature (34)..(36): n is a, c, g, or t
tgcaggaccagagaattcgaatacagactttggnnntgcatcaggt

SEQ ID NO: 4775 - DNA, 46 bp, Artificial Sequence
  Synthesized adaptor oligonucleotide
  misc_feature (34)..(36): n is a, c, g, or t
tgcaggaccagagaattcgaatacagaacatccnnntgcatcaggt

SEQ ID NO: 4776 - DNA, 46 bp, Artificial Sequence
  Synthesized adaptor oligonucleotide
  misc_feature (34)..(36): n is a, c, g, or t
tgcaggaccagagaattcgaatacacagcatcannntgcatcaggt

SEQ ID NO: 4777 - DNA, 46 bp, Artificial Sequence
  Synthesized adaptor oligonucleotide
  misc_feature (34)..(36): n is a, c, g, or t
tgcaggaccagagaattcgaatacacttctgacnnntgcatcaggt

SEQ ID NO: 4778 - DNA, 46 bp, Artificial Sequence
  Synthesized adaptor oligonucleotide
  misc_feature (34)..(36): n is a, c, g, or t
tgcaggaccagagaattcgaatacatcccgttannntgcatcaggt

SEQ ID NO: 4779 - DNA, 46 bp, Artificial Sequence
  Synthesized adaptor oligonucleotide
  misc_feature (34)..(36): n is a, c, g, or t
tgcaggaccagagaattcgaatacatttccatannntgcatcaggt

SEQ ID NO: 4780 - DNA, 46 bp, Artificial Sequence
  Synthesized adaptor oligonucleotide
  misc_feature (34)..(36): n is a, c, g, or t
tgcaggaccagagaattcgaatacacgtgcgacnnntgcatcaggt

SEQ ID NO: 4781 - DNA, 46 bp, Artificial Sequence
  Synthesized adaptor oligonucleotide
  misc_feature (34)..(36): n is a, c, g, or t
tgcaggaccagagaattcgaatacaacgctggcnnntgcatcaggt

SEQ ID NO: 4782 - DNA, 46 bp, Artificial Sequence
  Synthesized adaptor oligonucleotide
  misc_feature (34)..(36): n is a, c, g, or t
tgcaggaccagagaattcgaatacagagattccnnntgcatcaggt

SEQ ID NO: 4783 - DNA, 46 bp, Artificial Sequence
  Synthesized adaptor oligonucleotide
  misc_feature (34)..(36): n is a, c, g, or t
tgcaggaccagagaattcgaatacagaggactannntgcatcaggt

SEQ ID NO: 4784 - DNA, 46 bp, Artificial Sequence
  Synthesized adaptor oligonucleotide
  misc_feature (34)..(36): n is a, c, g, or t
tgcaggaccagagaattcgaatacattgattagnnntgcatcaggt

SEQ ID NO: 4785 - DNA, 46 bp, Artificial Sequence
  Synthesized adaptor oligonucleotide
  misc_feature (34)..(36): n is a, c, g, or t
tgcaggaccagagaattcgaatacacatgcatgnnntgcatcaggt

SEQ ID NO: 4786 - DNA, 46 bp, Artificial Sequence
  Synthesized adaptor oligonucleotide
  misc_feature (34)..(36): n is a, c, g, or t
tgcaggaccagagaattcgaatacattgaccctnnntgcatcaggt

SEQ ID NO: 4787 - DNA, 46 bp, Artificial Sequence
  Synthesized adaptor oligonucleotide
  misc_feature (34)..(36): n is a, c, g, or t
tgcaggaccagagaattcgaatacaggccactgnnntgcatcaggt

SEQ ID NO: 4788 - DNA, 46 bp, Artificial Sequence
  Synthesized adaptor oligonucleotide
  misc_feature (34)..(36): n is a, c, g, or t
tgcaggaccagagaattcgaatacattcctctcnnntgcatcaggt

SEQ ID NO: 4789 - DNA, 46 bp, Artificial Sequence
  Synthesized adaptor oligonucleotide
  misc_feature (34)..(36): n is a, c, g, or t
tgcaggaccagagaattcgaatacagcattcagnnntgcatcaggt

SEQ ID NO: 4790 - DNA, 46 bp, Artificial Sequence
  Synthesized adaptor oligonucleotide
  misc_feature (34)..(36): n is a, c, g, or t
tgcaggaccagagaattcgaatacagtaacttannntgcatcaggt

SEQ ID NO: 4791 - DNA, 46 bp, Artificial Sequence
  Synthesized adaptor oligonucleotide
  misc_feature (34)..(36): n is a, c, g, or t
tgcaggaccagagaattcgaatacaactatgatnnntgcatcaggt

SEQ ID NO: 4792 - DNA, 46 bp, Artificial Sequence
  Synthesized adaptor oligonucleotide
  misc_feature (34)..(36): n is a, c, g, or t
tgcaggaccagagaattcgaatacaactaagaannntgcatcaggt

SEQ ID NO: 4793 - DNA, 46 bp, Artificial Sequence
  Synthesized adaptor oligonucleotide
  misc_feature (34)..(36): n is a, c, g, or t
tgcaggaccagagaattcgaatacataggtttannntgcatcaggt

SEQ ID NO: 4794 - DNA, 46 bp, Artificial Sequence
  Synthesized adaptor oligonucleotide
  misc_feature (34)..(36): n is a, c, g, or t
tgcaggaccagagaattcgaatacacctcgtcgnnntgcatcaggt

SEQ ID NO: 4795 - DNA, 46 bp, Artificial Sequence
  Synthesized adaptor oligonucleotide
  misc_feature (34)..(36): n is a, c, g, or t
tgcaggaccagagaattcgaatacaggctagccnnntgcatcaggt

SEQ ID NO: 4796 - DNA, 46 bp, Artificial Sequence
  Synthesized adaptor oligonucleotide
  misc_feature (34)..(36): n is a, c, g, or t
tgcaggaccagagaattcgaatacaggttgtacnnntgcatcaggt

SEQ ID NO: 4797 - DNA, 46 bp, Artificial Sequence
  Synthesized adaptor oligonucleotide
  misc_feature (34)..(36): n is a, c, g, or t
tgcaggaccagagaattcgaatacataaagcggnnntgcatcaggt

SEQ ID NO: 4798 - DNA, 46 bp, Artificial Sequence
  Synthesized adaptor oligonucleotide
  misc_feature (34)..(36): n is a, c, g, or t
tgcaggaccagagaattcgaatacaaatctttcnnntgcatcaggt

SEQ ID NO: 4799 - DNA, 46 bp, Artificial Sequence
  Synthesized adaptor oligonucleotide
  misc_feature (34)..(36): n is a, c, g, or t
tgcaggaccagagaattcgaatacaccaaggaannntgcatcaggt

SEQ ID NO: 4800 - DNA, 46 bp, Artificial Sequence
  Synthesized adaptor oligonucleotide
  misc_feature (34)..(36): n is a, c, g, or t
tgcaggaccagagaattcgaatacaacaaaagtnnntgcatcaggt

SEQ ID NO: 4801 - DNA, 46 bp, Artificial Sequence
  Synthesized adaptor oligonucleotide
  misc_feature (34)..(36): n is a, c, g, or t
tgcaggaccagagaattcgaatacaggccccggnnntgcatcaggt

SEQ ID NO: 4802 - DNA, 46 bp, Artificial Sequence
  Synthesized adaptor oligonucleotide
  misc_feature (34)..(36): n is a, c, g, or t
tgcaggaccagagaattcgaatacaaacatgccnnntgcatcaggt

SEQ ID NO: 4803 - DNA, 46 bp, Artificial Sequence
  Synthesized adaptor oligonucleotide
  misc_feature (34)..(36): n is a, c, g, or t
tgcaggaccagagaattcgaatacatcggagttnnntgcatcaggt

SEQ ID NO: 4804 - DNA, 46 bp, Artificial Sequence
  Synthesized adaptor oligonucleotide
  misc_feature (34)..(36): n is a, c, g, or t
tgcaggaccagagaattcgaatacatagcggaannntgcatcaggt

SEQ ID NO: 4805 - DNA, 46 bp, Artificial Sequence
  Synthesized adaptor oligonucleotide
  misc_feature (34)..(36): n is a, c, g, or t
tgcaggaccagagaattcgaatacagtctactcnnntgcatcaggt

SEQ ID NO: 4806 - DNA, 46 bp, Artificial Sequence
  Synthesized adaptor oligonucleotide
  misc_feature (34)..(36): n is a, c, g, or t
tgcaggaccagagaattcgaatacatttgacccnnntgcatcaggt

SEQ ID NO: 4807 - DNA, 46 bp, Artificial Sequence
  Synthesized adaptor oligonucleotide
  misc_feature (34)..(36): n is a, c, g, or t
tgcaggaccagagaattcgaatacaaaggagagnnntgcatcaggt

SEQ ID NO: 4808 - DNA, 46 bp, Artificial Sequence
  Synthesized adaptor oligonucleotide
  misc_feature (34)..(36): n is a, c, g, or t
tgcaggaccagagaattcgaatacatttcgccannntgcatcaggt

SEQ ID NO: 4809 - DNA, 46 bp, Artificial Sequence
  Synthesized adaptor oligonucleotide
  misc_feature (34)..(36): n is a, c, g, or t
tgcaggaccagagaattcgaatacatgaaacaannnacgtatgcca

SEQ ID NO: 4810 - DNA, 46 bp, Artificial Sequence
  Synthesized adaptor oligonucleotide
  misc_feature (34)..(36): n is a, c, g, or t
tgcaggaccagagaattcgaatacaccgttgccnnnacgtatgcca

SEQ ID NO: 4811 - DNA, 46 bp, Artificial Sequence
  Synthesized adaptor oligonucleotide
  misc_feature (34)..(36): n is a, c, g, or t
tgcaggaccagagaattcgaatacagcattggtnnnacgtatgcca

SEQ ID NO: 4812 - DNA, 46 bp, Artificial Sequence
  Synthesized adaptor oligonucleotide
  misc_feature (34)..(36): n is a, c, g, or t
tgcaggaccagagaattcgaatacataggccatnnnacgtatgcca

SEQ ID NO: 4813 - DNA, 46 bp, Artificial Sequence
  Synthesized adaptor oligonucleotide
  misc_feature (34)..(36): n is a, c, g, or t
tgcaggaccagagaattcgaatacaactcctcannnacgtatgcca

SEQ ID NO: 4814 - DNA, 46 bp, Artificial Sequence
  Synthesized adaptor oligonucleotide
  misc_feature (34)..(36): n is a, c, g, or t
tgcaggaccagagaattcgaatacactaggcgcnnnacgtatgcca

SEQ ID NO: 4815 - DNA, 46 bp, Artificial Sequence
  Synthesized adaptor oligonucleotide
  misc_feature (34)..(36): n is a, c, g, or t
tgcaggaccagagaattcgaatacaagtttagtnnnacgtatgcca

SEQ ID NO: 4816 - DNA, 46 bp, Artificial Sequence
  Synthesized adaptor oligonucleotide
  misc_feature (34)..(36): n is a, c, g, or t
tgcaggaccagagaattcgaatacattgatacannnacgtatgcca

SEQ ID NO: 4817 - DNA, 46 bp, Artificial Sequence
  Synthesized adaptor oligonucleotide
  misc_feature (34)..(36): n is a, c, g, or t
tgcaggaccagagaattcgaatacaacaattacnnnacgtatgcca

SEQ ID NO: 4818 - DNA, 46 bp, Artificial Sequence
  Synthesized adaptor oligonucleotide
  misc_feature (34)..(36): n is a, c, g, or t
tgcaggaccagagaattcgaatacaataccggtnnnacgtatgcca

SEQ ID NO: 4819 - DNA, 46 bp, Artificial Sequence
  Synthesized adaptor oligonucleotide
  misc_feature (34)..(36): n is a, c, g, or t
tgcaggaccagagaattcgaatacatgaagcctnnnacgtatgcca

SEQ ID NO: 4820 - DNA, 46 bp, Artificial Sequence
  Synthesized adaptor oligonucleotide
  misc_feature (34)..(36): n is a, c, g, or t
tgcaggaccagagaattcgaatacattacctgcnnnacgtatgcca

SEQ ID NO: 4821 - DNA, 46 bp, Artificial Sequence
  Synthesized adaptor oligonucleotide
  misc_feature (34)..(36): n is a, c, g, or t
tgcaggaccagagaattcgaatacatatcagatnnnacgtatgcca

SEQ ID NO: 4822 - DNA, 46 bp, Artificial Sequence
  Synthesized adaptor oligonucleotide
  misc_feature (34)..(36): n is a, c, g, or t
tgcaggaccagagaattcgaatacagaagaattnnnacgtatgcca

SEQ ID NO: 4823 - DNA, 46 bp, Artificial Sequence
  Synthesized adaptor oligonucleotide
  misc_feature (34)..(36): n is a, c, g, or t
tgcaggaccagagaattcgaatacagatcacgtnnnacgtatgcca

SEQ ID NO: 4824 - DNA, 46 bp, Artificial Sequence
  Synthesized adaptor oligonucleotide
  misc_feature (34)..(36): n is a, c, g, or t
tgcaggaccagagaattcgaatacaaggtagacnnnacgtatgcca

SEQ ID NO: 4825 - DNA, 46 bp, Artificial Sequence
  Synthesized adaptor oligonucleotide
  misc_feature (34)..(36): n is a, c, g, or t
tgcaggaccagagaattcgaatacattgaccgannnacgtatgcca

SEQ ID NO: 4826 - DNA, 46 bp, Artificial Sequence
  Synthesized adaptor oligonucleotide
  misc_feature (34)..(36): n is a, c, g, or t
tgcaggaccagagaattcgaatacaccactgttnnnacgtatgcca

SEQ ID NO: 4827 - DNA, 46 bp, Artificial Sequence
  Synthesized adaptor oligonucleotide
  misc_feature (34)..(36): n is a, c, g, or t
tgcaggaccagagaattcgaatacagtcagaagnnnacgtatgcca

SEQ ID NO: 4828 - DNA, 46 bp, Artificial Sequence
  Synthesized adaptor oligonucleotide
  misc_feature (34)..(36): n is a, c, g, or t
tgcaggaccagagaattcgaatacaccgacctcnnnacgtatgcca

SEQ ID NO: 4829 - DNA, 46 bp, Artificial Sequence
  Synthesized adaptor oligonucleotide
  misc_feature (34)..(36): n is a, c, g, or t
tgcaggaccagagaattcgaatacaattagtgtnnnacgtatgcca

SEQ ID NO: 4830 - DNA, 46 bp, Artificial Sequence
  Synthesized adaptor oligonucleotide
  misc_feature (34)..(36): n is a, c, g, or t
tgcaggaccagagaattcgaatacagcataccannnacgtatgcca

SEQ ID NO: 4831 - DNA, 46 bp, Artificial Sequence
  Synthesized adaptor oligonucleotide
  misc_feature (34)..(36): n is a, c, g, or t
tgcaggaccagagaattcgaatacaagtttttcnnnacgtatgcca

SEQ ID NO: 4832 - DNA, 46 bp, Artificial Sequence
  Synthesized adaptor oligonucleotide
  misc_feature (34)..(36): n is a, c, g, or t
tgcaggaccagagaattcgaatacattcgcgttnnnacgtatgcca

SEQ ID NO: 4833 - DNA, 46 bp, Artificial Sequence
  Synthesized adaptor oligonucleotide
  misc_feature (34)..(36): n is a, c, g, or t
tgcaggaccagagaattcgaatacatggagcccnnnacgtatgcca

SEQ ID NO: 4834 - DNA, 46 bp, Artificial Sequence
  Synthesized adaptor oligonucleotide
  misc_feature (34)..(36): n is a, c, g, or t
tgcaggaccagagaattcgaatacacgtggcacnnnacgtatgcca

SEQ ID NO: 4835 - DNA, 46 bp, Artificial Sequence
  Synthesized adaptor oligonucleotide
  misc_feature (34)..(36): n is a, c, g, or t
tgcaggaccagagaattcgaatacatcttactannnacgtatgcca

SEQ ID NO: 4836 - DNA, 46 bp, Artificial Sequence
  Synthesized adaptor oligonucleotide
  misc_feature (34)..(36): n is a, c, g, or t
tgcaggaccagagaattcgaatacaatccggtannnacgtatgcca

SEQ ID NO: 4837 - DNA, 46 bp, Artificial Sequence
  Synthesized adaptor oligonucleotide
  misc_feature (34)..(36): n is a, c, g, or t
tgcaggaccagagaattcgaatacagacacctannnacgtatgcca

SEQ ID NO: 4838 - DNA, 46 bp, Artificial Sequence
  Synthesized adaptor oligonucleotide
  misc_feature (34)..(36): n is a, c, g, or t
tgcaggaccagagaattcgaatacatccgtctannnacgtatgcca

SEQ ID NO: 4839 - DNA, 46 bp, Artificial Sequence
  Synthesized adaptor oligonucleotide
  misc_feature (34)..(36): n is a, c, g, or t
tgcaggaccagagaattcgaatacaagattactnnnacgtatgcca

SEQ ID NO: 4840 - DNA, 46 bp, Artificial Sequence
  Synthesized adaptor oligonucleotide
  misc_feature (34)..(36): n is a, c, g, or t
tgcaggaccagagaattcgaatacaagattgaannnacgtatgcca

SEQ ID NO: 4841 - DNA, 46 bp, Artificial Sequence
  Synthesized adaptor oligonucleotide
  misc_feature (34)..(36): n is a, c, g, or t
tgcaggaccagagaattcgaatacatttaaagcnnnacgtatgcca

SEQ ID NO: 4842 - DNA, 46 bp, Artificial Sequence
  Synthesized adaptor oligonucleotide
  misc_feature (34)..(36): n is a, c, g, or t
tgcaggaccagagaattcgaatacagaattgccnnnacgtatgcca

SEQ ID NO: 4843 - DNA, 46 bp, Artificial Sequence
  Synthesized adaptor oligonucleotide
  misc_feature (34)..(36): n is a, c, g, or t
tgcaggaccagagaattcgaatacattacgtccnnnacgtatgcca

SEQ ID NO: 4844 - DNA, 46 bp, Artificial Sequence
  Synthesized adaptor oligonucleotide
  misc_feature (34)..(36): n is a, c, g, or t
tgcaggaccagagaattcgaatacaatgaggacnnnacgtatgcca

SEQ ID NO: 4845 - DNA, 46 bp, Artificial Sequence
  Synthesized adaptor oligonucleotide
  misc_feature (34)..(36): n is a, c, g, or t
tgcaggaccagagaattcgaatacaattgttagnnnacgtatgcca

SEQ ID NO: 4846 - DNA, 46 bp, Artificial Sequence
  Synthesized adaptor oligonucleotide
  misc_feature (34)..(36): n is a, c, g, or t
tgcaggaccagagaattcgaatacagcttgtagnnnacgtatgcca

SEQ ID NO: 4847 - DNA, 46 bp, Artificial Sequence
  Synthesized adaptor oligonucleotide
  misc_feature (34)..(36): n is a, c, g, or t
tgcaggaccagagaattcgaatacattgcttcgnnnacgtatgcca

SEQ ID NO: 4848 - DNA, 46 bp, Artificial Sequence
  Synthesized adaptor oligonucleotide
  misc_feature (34)..(36): n is a, c, g, or t
tgcaggaccagagaattcgaatacaaaaggctgnnnacgtatgcca

SEQ ID NO: 4849 - DNA, 46 bp, Artificial Sequence
  Synthesized adaptor oligonucleotide
  misc_feature (34)..(36): n is a, c, g, or t
tgcaggaccagagaattcgaatacacttacgagnnnacgtatgcca

SEQ ID NO: 4850 - DNA, 46 bp, Artificial Sequence
  Synthesized adaptor oligonucleotide
  misc_feature (34)..(36): n is a, c, g, or t
tgcaggaccagagaattcgaatacaatctatagnnnacgtatgcca

SEQ ID NO: 4851 - DNA, 46 bp, Artificial Sequence
  Synthesized adaptor oligonucleotide
  misc_feature (34)..(36): n is a, c, g, or t
tgcaggaccagagaattcgaatacaggtacactnnnacgtatgcca

SEQ ID NO: 4852 - DNA, 46 bp, Artificial Sequence
  Synthesized adaptor oligonucleotide
  misc_feature (34)..(36): n is a, c, g, or t
tgcaggaccagagaattcgaatacaccgcctcannnacgtatgcca

SEQ ID NO: 4853 - DNA, 46 bp, Artificial Sequence
  Synthesized adaptor oligonucleotide
  misc_feature (34)..(36): n is a, c, g, or t
tgcaggaccagagaattcgaatacacaggacggnnnacgtatgcca

SEQ ID NO: 4854 - DNA, 46 bp, Artificial Sequence
  Synthesized adaptor oligonucleotide
  misc_feature (34)..(36): n is a, c, g, or t
tgcaggaccagagaattcgaatacaatcatggcnnnacgtatgcca

SEQ ID NO: 4855 - DNA, 46 bp, Artificial Sequence
  Synthesized adaptor oligonucleotide
  misc_feature (34)..(36): n is a, c, g, or t
tgcaggaccagagaattcgaatacatataggttnnnacgtatgcca

SEQ ID NO: 4856 - DNA, 46 bp, Artificial Sequence
  Synthesized adaptor oligonucleotide
  misc_feature (34)..(36): n is a, c, g, or t
tgcaggaccagagaattcgaatacagatttaacnnnacgtatgcca

SEQ ID NO: 4857 - DNA, 46 bp, Artificial Sequence
  Synthesized adaptor oligonucleotide
  misc_feature (34)..(36): n is a, c, g, or t
tgcaggaccagagaattcgaatacaatggaacgnnnacgtatgcca

SEQ ID NO: 4858 - DNA, 46 bp, Artificial Sequence
  Synthesized adaptor oligonucleotide
  misc_feature (34)..(36): n is a, c, g, or t
tgcaggaccagagaattcgaatacagctttcacnnnacgtatgcca

SEQ ID NO: 4859 - DNA, 46 bp, Artificial Sequence
  Synthesized adaptor oligonucleotide
  misc_feature (34)..(36): n is a, c, g, or t
tgcaggaccagagaattcgaatacagtccgtggnnnacgtatgcca

SEQ ID NO: 4860 - DNA, 46 bp, Artificial Sequence
  Synthesized adaptor oligonucleotide
  misc_feature (34)..(36): n is a, c, g, or t
tgcaggaccagagaattcgaatacatactcccannnacgtatgcca

SEQ ID NO: 4861 - DNA, 46 bp, Artificial Sequence
  Synthesized adaptor oligonucleotide
  misc_feature (34)..(36): n is a, c, g, or t
tgcaggaccagagaattcgaatacagcccgtctnnnacgtatgcca

SEQ ID NO: 4862 - DNA, 46 bp, Artificial Sequence
  Synthesized adaptor oligonucleotide
  misc_feature (34)..(36): n is a, c, g, or t
tgcaggaccagagaattcgaatacagtcactgannnacgtatgcca

SEQ ID NO: 4863 - DNA, 46 bp, Artificial Sequence
  Synthesized adaptor oligonucleotide
  misc_feature (34)..(36): n is a, c, g, or t
tgcaggaccagagaattcgaatacaagccgaggnnnacgtatgcca

SEQ ID NO: 4864 - DNA, 46 bp, Artificial Sequence
  Synthesized adaptor oligonucleotide
  misc_feature (34)..(36): n is a, c, g, or t
tgcaggaccagagaattcgaatacagctatatannnacgtatgcca

SEQ ID NO: 4865 - DNA, 46 bp, Artificial Sequence
  Synthesized adaptor oligonucleotide
  misc_feature (34)..(36): n is a, c, g, or t
tgcaggaccagagaattcgaatacatctctcgannnacgtatgcca

SEQ ID NO: 4866 - DNA, 46 bp, Artificial Sequence
  Synthesized adaptor oligonucleotide
  misc_feature (34)..(36): n is a, c, g, or t
tgcaggaccagagaattcgaatacaacaatagannnacgtatgcca

SEQ ID NO: 4867 - DNA, 46 bp, Artificial Sequence
  Synthesized adaptor oligonucleotide
  misc_feature (34)..(36): n is a, c, g, or t
tgcaggaccagagaattcgaatacagagagcatnnnacgtatgcca

SEQ ID NO: 4868 - DNA, 46 bp, Artificial Sequence
  Synthesized adaptor oligonucleotide
  misc_feature (34)..(36): n is a, c, g, or t
tgcaggaccagagaattcgaatacacgatatgcnnnacgtatgcca

SEQ ID NO: 4869 - DNA, 46 bp, Artificial Sequence
  Synthesized adaptor oligonucleotide
  misc_feature (34)..(36): n is a, c, g, or t
tgcaggaccagagaattcgaatacacttcctctnnnctagcgttac

SEQ ID NO: 4870 - DNA, 46 bp, Artificial Sequence
  Synthesized adaptor oligonucleotide
  misc_feature (34)..(36): n is a, c, g, or t
tgcaggaccagagaattcgaatacaaacagtttnnnctagcgttac

SEQ ID NO: 4871 - DNA, 46 bp, Artificial Sequence
  Synthesized adaptor oligonucleotide
  misc_feature (34)..(36): n is a, c, g, or t
tgcaggaccagagaattcgaatacatgtggactnnnctagcgttac

SEQ ID NO: 4872 - DNA, 46 bp, Artificial Sequence
  Synthesized adaptor oligonucleotide
  misc_feature (34)..(36): n is a, c, g, or t
tgcaggaccagagaattcgaatacacctcgcacnnnctagcgttac

SEQ ID NO: 4873 - DNA, 46 bp, Artificial Sequence
  Synthesized adaptor oligonucleotide
  misc_feature (34)..(36): n is a, c, g, or t
tgcaggaccagagaattcgaatacacggtttctnnnctagcgttac

SEQ ID NO: 4874 - DNA, 46 bp, Artificial Sequence
  Synthesized adaptor oligonucleotide
  misc_feature (34)..(36): n is a, c, g, or t
tgcaggaccagagaattcgaatacaacgtcgatnnnctagcgttac

SEQ ID NO: 4875 - DNA, 46 bp, Artificial Sequence
  Synthesized adaptor oligonucleotide
  misc_feature (34)..(36): n is a, c, g, or t
tgcaggaccagagaattcgaatacattggcttcnnnctagcgttac

SEQ ID NO: 4876 - DNA, 46 bp, Artificial Sequence
  Synthesized adaptor oligonucleotide
  misc_feature (34)..(36): n is a, c, g, or t
tgcaggaccagagaattcgaatacaatggacgannnctagcgttac

SEQ ID NO: 4877 - DNA, 46 bp, Artificial Sequence
  Synthesized adaptor oligonucleotide
  misc_feature (34)..(36): n is a, c, g, or t
tgcaggaccagagaattcgaatacatgcaagagnnnctagcgttac

SEQ ID NO: 4878 - DNA, 46 bp, Artificial Sequence
  Synthesized adaptor oligonucleotide
  misc_feature (34)..(36): n is a, c, g, or t
tgcaggaccagagaattcgaatacagaaatatgnnnctagcgttac

SEQ ID NO: 4879 - DNA, 46 bp, Artificial Sequence
  Synthesized adaptor oligonucleotide
  misc_feature (34)..(36): n is a, c, g, or t
tgcaggaccagagaattcgaatacaacacatatnnnctagcgttac

SEQ ID NO: 4880 - DNA, 46 bp, Artificial Sequence
  Synthesized adaptor oligonucleotide
  misc_feature (34)..(36): n is a, c, g, or t
tgcaggaccagagaattcgaatacagtacgactnnnctagcgttac

SEQ ID NO: 4881 - DNA, 46 bp, Artificial Sequence
  Synthesized adaptor oligonucleotide
  misc_feature (34)..(36): n is a, c, g, or t
tgcaggaccagagaattcgaatacacgccgcggnnnctagcgttac

SEQ ID NO: 4882 - DNA, 46 bp, Artificial Sequence
  Synthesized adaptor oligonucleotide
  misc_feature (34)..(36): n is a, c, g, or t
tgcaggaccagagaattcgaatacatagtgcacnnnctagcgttac

SEQ ID NO: 4883 - DNA, 46 bp, Artificial Sequence
  Synthesized adaptor oligonucleotide
  misc_feature (34)..(36): n is a, c, g, or t
tgcaggaccagagaattcgaatacatcaatgcgnnnctagcgttac

SEQ ID NO: 4884 - DNA, 46 bp, Artificial Sequence
  Synthesized adaptor oligonucleotide
  misc_feature (34)..(36): n is a, c, g, or t
tgcaggaccagagaattcgaatacaatgtaagannnctagcgttac

SEQ ID NO: 4885 - DNA, 46 bp, Artificial Sequence
  Synthesized adaptor oligonucleotide
  misc_feature (34)..(36): n is a, c, g, or t
tgcaggaccagagaattcgaatacatatgttagnnnctagcgttac

SEQ ID NO: 4886 - DNA, 46 bp, Artificial Sequence
  Synthesized adaptor oligonucleotide
  misc_feature (34)..(36): n is a, c, g, or t
tgcaggaccagagaattcgaatacatcaaatcannnctagcgttac

SEQ ID NO: 4887 - DNA, 46 bp, Artificial Sequence
  Synthesized adaptor oligonucleotide
  misc_feature (34)..(36): n is a, c, g, or t
tgcaggaccagagaattcgaatacacacttaggnnnctagcgttac

SEQ ID NO: 4888 - DNA, 46 bp, Artificial Sequence
  Synthesized adaptor oligonucleotide
  misc_feature (34)..(36): n is a, c, g, or t
tgcaggaccagagaattcgaatacataggataannnctagcgttac

SEQ ID NO: 4889 - DNA, 46 bp, Artificial Sequence
  Synthesized adaptor oligonucleotide
  misc_feature (34)..(36): n is a, c, g, or t
tgcaggaccagagaattcgaatacaatcccgttnnnctagcgttac

SEQ ID NO: 4890 - DNA, 46 bp, Artificial Sequence
  Synthesized adaptor oligonucleotide
  misc_feature (34)..(36): n is a, c, g, or t
tgcaggaccagagaattcgaatacaacaatccgnnnctagcgttac

SEQ ID NO: 4891 - DNA, 46 bp, Artificial Sequence
  Synthesized adaptor oligonucleotide
  misc_feature (34)..(36): n is a, c, g, or t
tgcaggaccagagaattcgaatacactattaagnnnctagcgttac

SEQ ID NO: 4892 - DNA, 46 bp, Artificial Sequence
  Synthesized adaptor oligonucleotide
  misc_feature (34)..(36): n is a, c, g, or t
tgcaggaccagagaattcgaatacagcgtatgtnnnctagcgttac

SEQ ID NO: 4893 - DNA, 46 bp, Artificial Sequence
  Synthesized adaptor oligonucleotide
  misc_feature (34)..(36): n is a, c, g, or t
tgcaggaccagagaattcgaatacaattggtatnnnctagcgttac

SEQ ID NO: 4894 - DNA, 46 bp, Artificial Sequence
  Synthesized adaptor oligonucleotide
  misc_feature (34)..(36): n is a, c, g, or t
tgcaggaccagagaattcgaatacatttctgcgnnnctagcgttac

SEQ ID NO: 4895 - DNA, 46 bp, Artificial Sequence
  Synthesized adaptor oligonucleotide
  misc_feature (34)..(36): n is a, c, g, or t
tgcaggaccagagaattcgaatacagaatcccannnctagcgttac

SEQ ID NO: 4896 - DNA, 46 bp, Artificial Sequence
  Synthesized adaptor oligonucleotide
  misc_feature (34)..(36): n is a, c, g, or t
tgcaggaccagagaattcgaatacactttcacgnnnctagcgttac

SEQ ID NO: 4897 - DNA, 46 bp, Artificial Sequence
  Synthesized adaptor oligonucleotide
  misc_feature (34)..(36): n is a, c, g, or t
tgcaggaccagagaattcgaatacacggatcatnnnctagcgttac

SEQ ID NO: 4898 - DNA, 46 bp, Artificial Sequence
  Synthesized adaptor oligonucleotide
  misc_feature (34)..(36): n is a, c, g, or t
tgcaggaccagagaattcgaatacaacagtgctnnnctagcgttac

SEQ ID NO: 4899 - DNA, 46 bp, Artificial Sequence
  Synthesized adaptor oligonucleotide
  misc_feature (34)..(36): n is a, c, g, or t
tgcaggaccagagaattcgaatacacttagtccnnnctagcgttac

SEQ ID NO: 4900 - DNA, 46 bp, Artificial Sequence
  Synthesized adaptor oligonucleotide
  misc_feature (34)..(36): n is a, c, g, or t
tgcaggaccagagaattcgaatacaagtgcccgnnnctagcgttac

SEQ ID NO: 4901 - DNA, 46 bp, Artificial Sequence
  Synthesized adaptor oligonucleotide
  misc_feature (34)..(36): n is a, c, g, or t
tgcaggaccagagaattcgaatacatgaaatctnnnctagcgttac

SEQ ID NO: 4902 - DNA, 46 bp, Artificial Sequence
  Synthesized adaptor oligonucleotide
  misc_feature (34)..(36): n is a, c, g, or t
tgcaggaccagagaattcgaatacatcagttaannnctagcgttac

SEQ ID NO: 4903 - DNA, 46 bp, Artificial Sequence
  Synthesized adaptor oligonucleotide
  misc_feature (34)..(36): n is a, c, g, or t
tgcaggaccagagaattcgaatacaaaccctgannnctagcgttac

SEQ ID NO: 4904 - DNA, 46 bp, Artificial Sequence
  Synthesized adaptor oligonucleotide
  misc_feature (34)..(36): n is a, c, g, or t
tgcaggaccagagaattcgaatacatcatgatannnctagcgttac

SEQ ID NO: 4905 - DNA, 46 bp, Artificial Sequence
  Synthesized adaptor oligonucleotide
  misc_feature (34)..(36): n is a, c, g, or t
tgcaggaccagagaattcgaatacaaagccttgnnnctagcgttac

SEQ ID NO: 4906 - DNA, 46 bp, Artificial Sequence
  Synthesized adaptor oligonucleotide
  misc_feature (34)..(36): n is a, c, g, or t
tgcaggaccagagaattcgaatacaagcataccnnnctagcgttac

SEQ ID NO: 4907 - DNA, 46 bp, Artificial Sequence
  Synthesized adaptor oligonucleotide
  misc_feature (34)..(36): n is a, c, g, or t
tgcaggaccagagaattcgaatacaggcatttgnnnctagcgttac

SEQ ID NO: 4908 - DNA, 46 bp, Artificial Sequence
  Synthesized adaptor oligonucleotide
  misc_feature (34)..(36): n is a, c, g, or t
tgcaggaccagagaattcgaatacagcgagtccnnnctagcgttac

SEQ ID NO: 4909 - DNA, 46 bp, Artificial Sequence
  Synthesized adaptor oligonucleotide
  misc_feature (34)..(36): n is a, c, g, or t
tgcaggaccagagaattcgaatacattttgagannnctagcgttac

SEQ ID NO: 4910 - DNA, 46 bp, Artificial Sequence
  Synthesized adaptor oligonucleotide
  misc_feature (34)..(36): n is a, c, g, or t
tgcaggaccagagaattcgaatacaatccttatnnnctagcgttac

SEQ ID NO: 4911 - DNA, 46 bp, Artificial Sequence
  Synthesized adaptor oligonucleotide
  misc_feature (34)..(36): n is a, c, g, or t
tgcaggaccagagaattcgaatacatcgaaaaannnctagcgttac

SEQ ID NO: 4912 - DNA, 46 bp, Artificial Sequence
  Synthesized adaptor oligonucleotide
  misc_feature (34)..(36): n is a, c, g, or t
tgcaggaccagagaattcgaatacagctccgtcnnnctagcgttac

SEQ ID NO: 4913 - DNA, 46 bp, Artificial Sequence
  Synthesized adaptor oligonucleotide
  misc_feature (34)..(36): n is a, c, g, or t
tgcaggaccagagaattcgaatacaccagtttcnnnctagcgttac

SEQ ID NO: 4914 - DNA, 46 bp, Artificial Sequence
  Synthesized adaptor oligonucleotide
  misc_feature (34)..(36): n is a, c, g, or t
tgcaggaccagagaattcgaatacacttggcttnnnctagcgttac

SEQ ID NO: 4915 - DNA, 46 bp, Artificial Sequence
  Synthesized adaptor oligonucleotide
  misc_feature (34)..(36): n is a, c, g, or t
tgcaggaccagagaattcgaatacaccgccatcnnnctagcgttac

SEQ ID NO: 4916 - DNA, 46 bp, Artificial Sequence
  Synthesized adaptor oligonucleotide
  misc_feature (34)..(36): n is a, c, g, or t
tgcaggaccagagaattcgaatacagatcgatcnnnctagcgttac

SEQ ID NO: 4917 - DNA, 46 bp, Artificial Sequence
  Synthesized adaptor oligonucleotide
  misc_feature (34)..(36): n is a, c, g, or t
tgcaggaccagagaattcgaatacaacgcggctnnnctagcgttac

SEQ ID NO: 4918 - DNA, 46 bp, Artificial Sequence
  Synthesized adaptor oligonucleotide
  misc_feature (34)..(36): n is a, c, g, or t
tgcaggaccagagaattcgaatacatctcgagannnctagcgttac

SEQ ID NO: 4919 - DNA, 46 bp, Artificial Sequence
  Synthesized adaptor oligonucleotide
  misc_feature (34)..(36): n is a, c, g, or t
tgcaggaccagagaattcgaatacaattggcacnnnctagcgttac

SEQ ID NO: 4920 - DNA, 46 bp, Artificial Sequence
  Synthesized adaptor oligonucleotide
  misc_feature (34)..(36): n is a, c, g, or t
tgcaggaccagagaattcgaatacacgccgagtnnnctagcgttac

SEQ ID NO: 4921 - DNA, 46 bp, Artificial Sequence
  Synthesized adaptor oligonucleotide
  misc_feature (34)..(36): n is a, c, g, or t
tgcaggaccagagaattcgaatacacttcagctnnnctagcgttac

SEQ ID NO: 4922 - DNA, 46 bp, Artificial Sequence
  Synthesized adaptor oligonucleotide
  misc_feature (34)..(36): n is a, c, g, or t
tgcaggaccagagaattcgaatacaaaataagcnnnctagcgttac

SEQ ID NO: 4923 - DNA, 46 bp, Artificial Sequence
  Synthesized adaptor oligonucleotide
  misc_feature (34)..(36): n is a, c, g, or t
tgcaggaccagagaattcgaatacagcctaagtnnnctagcgttac

SEQ ID NO: 4924 - DNA, 46 bp, Artificial Sequence
  Synthesized adaptor oligonucleotide
  misc_feature (34)..(36): n is a, c, g, or t
tgcaggaccagagaattcgaatacagatgttcgnnnctagcgttac

SEQ ID NO: 4925 - DNA, 46 bp, Artificial Sequence
  Synthesized adaptor oligonucleotide
  misc_feature (34)..(36): n is a, c, g, or t
tgcaggaccagagaattcgaatacaaacgaggtnnnctagcgttac

SEQ ID NO: 4926 - DNA, 46 bp, Artificial Sequence
  Synthesized adaptor oligonucleotide
  misc_feature (34)..(36): n is a, c, g, or t
tgcaggaccagagaattcgaatacaatagacaannnctagcgttac

SEQ ID NO: 4927 - DNA, 46 bp, Artificial Sequence
  Synthesized adaptor oligonucleotide
  misc_feature (34)..(36): n is a, c, g, or t
tgcaggaccagagaattcgaatacatatttggannnctagcgttac

SEQ ID NO: 4928 - DNA, 46 bp, Artificial Sequence
  Synthesized adaptor oligonucleotide
  misc_feature (34)..(36): n is a, c, g, or t
tgcaggaccagagaattcgaatacatccgtgttnnnctagcgttac

SEQ ID NO: 4929 - DNA, 46 bp, Artificial Sequence
  Synthesized adaptor oligonucleotide
  misc_feature (34)..(36): n is a, c, g, or t
tgcaggaccagagaattcgaatacatcctcgatnnngatcgacatg

SEQ ID NO: 4930 - DNA, 46 bp, Artificial Sequence
  Synthesized adaptor oligonucleotide
  misc_feature (34)..(36): n is a, c, g, or t
tgcaggaccagagaattcgaatacatttggagcnnngatcgacatg

SEQ ID NO: 4931 - DNA, 46 bp, Artificial Sequence
  Synthesized adaptor oligonucleotide
  misc_feature (34)..(36): n is a, c, g, or t
tgcaggaccagagaattcgaatacacttccacannngatcgacatg

SEQ ID NO: 4932 - DNA, 46 bp, Artificial Sequence
  Synthesized adaptor oligonucleotide
  misc_feature (34)..(36): n is a, c, g, or t
tgcaggaccagagaattcgaatacaaatttgcannngatcgacatg

SEQ ID NO: 4933 - DNA, 46 bp, Artificial Sequence
  Synthesized adaptor oligonucleotide
  misc_feature (34)..(36): n is a, c, g, or t
tgcaggaccagagaattcgaatacaaatctgatnnngatcgacatg

SEQ ID NO: 4934 - DNA, 46 bp, Artificial Sequence
  Synthesized adaptor oligonucleotide
  misc_feature (34)..(36): n is a, c, g, or t
tgcaggaccagagaattcgaatacatccacttgnnngatcgacatg

SEQ ID NO: 4935 - DNA, 46 bp, Artificial Sequence
  Synthesized adaptor oligonucleotide
  misc_feature (34)..(36): n is a, c, g, or t
tgcaggaccagagaattcgaatacatggttagcnnngatcgacatg

SEQ ID NO: 4936 - DNA, 46 bp, Artificial Sequence
  Synthesized adaptor oligonucleotide
  misc_feature (34)..(36): n is a, c, g, or t
tgcaggaccagagaattcgaatacactgtaacgnnngatcgacatg

SEQ ID NO: 4937 - DNA, 46 bp, Artificial Sequence
  Synthesized adaptor oligonucleotide
  misc_feature (34)..(36): n is a, c, g, or t
tgcaggaccagagaattcgaatacatattagtgnnngatcgacatg

SEQ ID NO: 4938 - DNA, 46 bp, Artificial Sequence
  Synthesized adaptor oligonucleotide
  misc_feature (34)..(36): n is a, c, g, or t
tgcaggaccagagaattcgaatacatgcacatgnnngatcgacatg

SEQ ID NO: 4939 - DNA, 46 bp, Artificial Sequence
  Synthesized adaptor oligonucleotide
  misc_feature (34)..(36): n is a, c, g, or t
tgcaggaccagagaattcgaatacaaccttcgtnnngatcgacatg

SEQ ID NO: 4940 - DNA, 46 bp, Artificial Sequence
  Synthesized adaptor oligonucleotide
  misc_feature (34)..(36): n is a, c, g, or t
tgcaggaccagagaattcgaatacagcgtgcacnnngatcgacatg

SEQ ID NO: 4941 - DNA, 46 bp, Artificial Sequence
  Synthesized adaptor oligonucleotide
  misc_feature (34)..(36): n is a, c, g, or t
tgcaggaccagagaattcgaatacacgcctttannngatcgacatg

SEQ ID NO: 4942 - DNA, 46 bp, Artificial Sequence
  Synthesized adaptor oligonucleotide
  misc_feature (34)..(36): n is a, c, g, or t
tgcaggaccagagaattcgaatacattgtaaacnnngatcgacatg

SEQ ID NO: 4943 - DNA, 46 bp, Artificial Sequence
  Synthesized adaptor oligonucleotide
  misc_feature (34)..(36): n is a, c, g, or t
tgcaggaccagagaattcgaatacaaacgcaagnnngatcgacatg

SEQ ID NO: 4944 - DNA, 46 bp, Artificial Sequence
  Synthesized adaptor oligonucleotide
  misc_feature (34)..(36): n is a, c, g, or t
tgcaggaccagagaattcgaatacagtaatcatnnngatcgacatg

SEQ ID NO: 4945 - DNA, 46 bp, Artificial Sequence
  Synthesized adaptor oligonucleotide
  misc_feature (34)..(36): n is a, c, g, or t
tgcaggaccagagaattcgaatacagtctgcttnnngatcgacatg

SEQ ID NO: 4946 - DNA, 46 bp, Artificial Sequence
  Synthesized adaptor oligonucleotide
  misc_feature (34)..(36): n is a, c, g, or t
tgcaggaccagagaattcgaatacagatggttcnnngatcgacatg

SEQ ID NO: 4947 - DNA, 46 bp, Artificial Sequence
  Synthesized adaptor oligonucleotide
  misc_feature (34)..(36): n is a, c, g, or t
tgcaggaccagagaattcgaatacacttggcaannngatcgacatg

SEQ ID NO: 4948 - DNA, 46 bp, Artificial Sequence
  Synthesized adaptor oligonucleotide
  misc_feature (34)..(36): n is a, c, g, or t
tgcaggaccagagaattcgaatacataccgaacnnngatcgacatg

SEQ ID NO: 4949 - DNA, 46 bp, Artificial Sequence
  Synthesized adaptor oligonucleotide
  misc_feature (34)..(36): n is a, c, g, or t
tgcaggaccagagaattcgaatacagtgagtgannngatcgacatg

SEQ ID NO: 4950 - DNA, 46 bp, Artificial Sequence
  Synthesized adaptor oligonucleotide
  misc_feature (34)..(36): n is a, c, g, or t
tgcaggaccagagaattcgaatacacaggtgaannngatcgacatg

SEQ ID NO: 4951 - DNA, 46 bp, Artificial Sequence
  Synthesized adaptor oligonucleotide
  misc_feature (34)..(36): n is a, c, g, or t
tgcaggaccagagaattcgaatacaaggtcagannngatcgacatg

SEQ ID NO: 4952 - DNA, 46 bp, Artificial Sequence
  Synthesized adaptor oligonucleotide
  misc_feature (34)..(36): n is a, c, g, or t
tgcaggaccagagaattcgaatacagagcgtttnnngatcgacatg

SEQ ID NO: 4953 - DNA, 46 bp, Artificial Sequence
  Synthesized adaptor oligonucleotide
  misc_feature (34)..(36): n is a, c, g, or t
tgcaggaccagagaattcgaatacagaaatggcnnngatcgacatg

SEQ ID NO: 4954 - DNA, 46 bp, Artificial Sequence
  Synthesized adaptor oligonucleotide
  misc_feature (34)..(36): n is a, c, g, or t
tgcaggaccagagaattcgaatacagagtgtctnnngatcgacatg

SEQ ID NO: 4955 - DNA, 46 bp, Artificial Sequence
  Synthesized adaptor oligonucleotide
  misc_feature (34)..(36): n is a, c, g, or t
tgcaggaccagagaattcgaatacaaaacatctnnngatcgacatg

SEQ ID NO: 4956 - DNA, 46 bp, Artificial Sequence
  Synthesized adaptor oligonucleotide
  misc_feature (34)..(36): n is a, c, g, or t
tgcaggaccagagaattcgaatacataaagcttnnngatcgacatg

SEQ ID NO: 4957 - DNA, 46 bp, Artificial Sequence
  Synthesized adaptor oligonucleotide
  misc_feature (34)..(36): n is a, c, g, or t
tgcaggaccagagaattcgaatacattagtgcgnnngatcgacatg

SEQ ID NO: 4958 - DNA, 46 bp, Artificial Sequence
  Synthesized adaptor oligonucleotide
  misc_feature (34)..(36): n is a, c, g, or t
tgcaggaccagagaattcgaatacagttcgcccnnngatcgacatg

SEQ ID NO: 4959 - DNA, 46 bp, Artificial Sequence
  Synthesized adaptor oligonucleotide
  misc_feature (34)..(36): n is a, c, g, or t
tgcaggaccagagaattcgaatacagtgacctannngatcgacatg

SEQ ID NO: 4960 - DNA, 46 bp, Artificial Sequence
  Synthesized adaptor oligonucleotide
  misc_feature (34)..(36): n is a, c, g, or t
tgcaggaccagagaattcgaatacaggacaatgnnngatcgacatg

SEQ ID NO: 4961 - DNA, 46 bp, Artificial Sequence
  Synthesized adaptor oligonucleotide
  misc_feature (34)..(36): n is a, c, g, or t
tgcaggaccagagaattcgaatacatataggaannngatcgacatg

SEQ ID NO: 4962 - DNA, 46 bp, Artificial Sequence
  Synthesized adaptor oligonucleotide
  misc_feature (34)..(36): n is a, c, g, or t
tgcaggaccagagaattcgaatacactagcggcnnngatcgacatg

SEQ ID NO: 4963 - DNA, 46 bp, Artificial Sequence
  Synthesized adaptor oligonucleotide
  misc_feature (34)..(36): n is a, c, g, or t
tgcaggaccagagaattcgaatacagcgtttagnnngatcgacatg

SEQ ID NO: 4964 - DNA, 46 bp, Artificial Sequence
  Synthesized adaptor oligonucleotide
  misc_feature (34)..(36): n is a, c, g, or t
tgcaggaccagagaattcgaatacagtatgtcgnnngatcgacatg

SEQ ID NO: 4965 - DNA, 46 bp, Artificial Sequence
  Synthesized adaptor oligonucleotide
  misc_feature (34)..(36): n is a, c, g, or t
tgcaggaccagagaattcgaatacacatgtgacnnngatcgacatg

SEQ ID NO: 4966 - DNA, 46 bp, Artificial Sequence
  Synthesized adaptor oligonucleotide
  misc_feature (34)..(36): n is a, c, g, or t
tgcaggaccagagaattcgaatacaatcaaaagnnngatcgacatg

SEQ ID NO: 4967 - DNA, 46 bp, Artificial Sequence
  Synthesized adaptor oligonucleotide
  misc_feature (34)..(36): n is a, c, g, or t
tgcaggaccagagaattcgaatacaataaactcnnngatcgacatg

SEQ ID NO: 4968 - DNA, 46 bp, Artificial Sequence
  Synthesized adaptor oligonucleotide
  misc_feature (34)..(36): n is a, c, g, or t
tgcaggaccagagaattcgaatacaccggatcgnnngatcgacatg

SEQ ID NO: 4969 - DNA, 46 bp, Artificial Sequence
  Synthesized adaptor oligonucleotide
  misc_feature (34)..(36): n is a, c, g, or t
tgcaggaccagagaattcgaatacaccggctagnnngatcgacatg

SEQ ID NO: 4970 - DNA, 46 bp, Artificial Sequence
  Synthesized adaptor oligonucleotide
  misc_feature (34)..(36): n is a, c, g, or t
tgcaggaccagagaattcgaatacactgtggtannngatcgacatg

SEQ ID NO: 4971 - DNA, 46 bp, Artificial Sequence
  Synthesized adaptor oligonucleotide
  misc_feature (34)..(36): n is a, c, g, or t
tgcaggaccagagaattcgaatacagaacgtgannngatcgacatg

SEQ ID NO: 4972 - DNA, 46 bp, Artificial Sequence
  Synthesized adaptor oligonucleotide
  misc_feature (34)..(36): n is a, c, g, or t
tgcaggaccagagaattcgaatacacggctgacnnngatcgacatg

SEQ ID NO: 4973 - DNA, 46 bp, Artificial Sequence
  Synthesized adaptor oligonucleotide
  misc_feature (34)..(36): n is a, c, g, or t
tgcaggaccagagaattcgaatacaggcatcatnnngatcgacatg

SEQ ID NO: 4974 - DNA, 46 bp, Artificial Sequence
  Synthesized adaptor oligonucleotide
  misc_feature (34)..(36): n is a, c, g, or t
tgcaggaccagagaattcgaatacaccgcaggtnnngatcgacatg

SEQ ID NO: 4975 - DNA, 46 bp, Artificial Sequence
  Synthesized adaptor oligonucleotide
  misc_feature (34)..(36): n is a, c, g, or t
tgcaggaccagagaattcgaatacatcctactgnnngatcgacatg

SEQ ID NO: 4976 - DNA, 46 bp, Artificial Sequence
  Synthesized adaptor oligonucleotide
  misc_feature (34)..(36): n is a, c, g, or t
tgcaggaccagagaattcgaatacatcccgaccnnngatcgacatg

SEQ ID NO: 4977 - DNA, 46 bp, Artificial Sequence
  Synthesized adaptor oligonucleotide
  misc_feature (34)..(36): n is a, c, g, or t
tgcaggaccagagaattcgaatacatgtaggtcnnngatcgacatg

SEQ ID NO: 4978 - DNA, 46 bp, Artificial Sequence
  Synthesized adaptor oligonucleotide
  misc_feature (34)..(36): n is a, c, g, or t
tgcaggaccagagaattcgaatacacggcgctannngatcgacatg

SEQ ID NO: 4979 - DNA, 46 bp, Artificial Sequence
  Synthesized adaptor oligonucleotide
  misc_feature (34)..(36): n is a, c, g, or t
tgcaggaccagagaattcgaatacacctatttannngatcgacatg

SEQ ID NO: 4980 - DNA, 46 bp, Artificial Sequence
  Synthesized adaptor oligonucleotide
  misc_feature (34)..(36): n is a, c, g, or t
tgcaggaccagagaattcgaatacagaacaagcnnngatcgacatg

SEQ ID NO: 4981 - DNA, 46 bp, Artificial Sequence
  Synthesized adaptor oligonucleotide
  misc_feature (34)..(36): n is a, c, g, or t
tgcaggaccagagaattcgaatacatcccattgnnngatcgacatg

SEQ ID NO: 4982 - DNA, 46 bp, Artificial Sequence
  Synthesized adaptor oligonucleotide
  misc_feature (34)..(36): n is a, c, g, or t
tgcaggaccagagaattcgaatacatactgtggnnngatcgacatg

SEQ ID NO: 4983 - DNA, 46 bp, Artificial Sequence
  Synthesized adaptor oligonucleotide
  misc_feature (34)..(36): n is a, c, g, or t
tgcaggaccagagaattcgaatacagcgcttaannngatcgacatg

SEQ ID NO: 4984 - DNA, 46 bp, Artificial Sequence
  Synthesized adaptor oligonucleotide
  misc_feature (34)..(36): n is a, c, g, or t
tgcaggaccagagaattcgaatacagcctcccannngatcgacatg

SEQ ID NO: 4985 - DNA, 46 bp, Artificial Sequence
  Synthesized adaptor oligonucleotide
  misc_feature (34)..(36): n is a, c, g, or t
tgcaggaccagagaattcgaatacacacgatacnnngatcgacatg

SEQ ID NO: 4986 - DNA, 46 bp, Artificial Sequence
  Synthesized adaptor oligonucleotide
  misc_feature (34)..(36): n is a, c, g, or t
tgcaggaccagagaattcgaatacagtgtcaacnnngatcgacatg

SEQ ID NO: 4987 - DNA, 46 bp, Artificial Sequence
  Synthesized adaptor oligonucleotide
  misc_feature (34)..(36): n is a, c, g, or t
tgcaggaccagagaattcgaatacatacgccggnnngatcgacatg

SEQ ID NO: 4988 - DNA, 46 bp, Artificial Sequence
  Synthesized adaptor oligonucleotide
  misc_feature (34)..(36): n is a, c, g, or t
tgcaggaccagagaattcgaatacaaatccgacnnngatcgacatg

SEQ ID NO: 4989 - DNA, 46 bp, Artificial Sequence
  Synthesized adaptor oligonucleotide
  misc_feature (34)..(36): n is a, c, g, or t
tgcaggaccagagaattcgaatacagccgccggnnntgcatcaggt

SEQ ID NO: 4990 - DNA, 46 bp, Artificial Sequence
  Synthesized adaptor oligonucleotide
  misc_feature (34)..(36): n is a, c, g, or t
tgcaggaccagagaattcgaatacacctgccgtnnntgcatcaggt

SEQ ID NO: 4991 - DNA, 46 bp, Artificial Sequence
  Synthesized adaptor oligonucleotide
  misc_feature (34)..(36): n is a, c, g, or t
tgcaggaccagagaattcgaatacacgttacctnnntgcatcaggt

SEQ ID NO: 4992 - DNA, 46 bp, Artificial Sequence
  Synthesized adaptor oligonucleotide
  misc_feature (34)..(36): n is a, c, g, or t
tgcaggaccagagaattcgaatacacgattagcnnntgcatcaggt

SEQ ID NO: 4993 - DNA, 46 bp, Artificial Sequence
  Synthesized adaptor oligonucleotide
  misc_feature (34)..(36): n is a, c, g, or t
tgcaggaccagagaattcgaatacaaacctaatnnntgcatcaggt

SEQ ID NO: 4994 - DNA, 46 bp, Artificial Sequence
  Synthesized adaptor oligonucleotide
  misc_feature (34)..(36): n is a, c, g, or t
tgcaggaccagagaattcgaatacaatcggctannntgcatcaggt

SEQ ID NO: 4995 - DNA, 46 bp, Artificial Sequence
  Synthesized adaptor oligonucleotide
  misc_feature (34)..(36): n is a, c, g, or t
tgcaggaccagagaattcgaatacaggaaccccnnntgcatcaggt

SEQ ID NO: 4996 - DNA, 46 bp, Artificial Sequence
  Synthesized adaptor oligonucleotide
  misc_feature (34)..(36): n is a, c, g, or t
tgcaggaccagagaattcgaatacatcacacagnnntgcatcaggt

SEQ ID NO: 4997 - DNA, 46 bp, Artificial Sequence
  Synthesized adaptor oligonucleotide
  misc_feature (34)..(36): n is a, c, g, or t
tgcaggaccagagaattcgaatacactattgaannntgcatcaggt

SEQ ID NO: 4998 - DNA, 46 bp, Artificial Sequence
  Synthesized adaptor oligonucleotide
  misc_feature (34)..(36): n is a, c, g, or t
tgcaggaccagagaattcgaatacacgcgatatnnntgcatcaggt

SEQ ID NO: 4999 - DNA, 46 bp, Artificial Sequence
  Synthesized adaptor oligonucleotide
  misc_feature (34)..(36): n is a, c, g, or t
tgcaggaccagagaattcgaatacacttatgttnnntgcatcaggt

SEQ ID NO: 5000 - DNA, 46 bp, Artificial Sequence
  Synthesized adaptor oligonucleotide
  misc_feature (34)..(36): n is a, c, g, or t
tgcaggaccagagaattcgaatacaatttggtannntgcatcaggt

SEQ ID NO: 5001 - DNA, 46 bp, Artificial Sequence
  Synthesized adaptor oligonucleotide
  misc_feature (34)..(36): n is a, c, g, or t
tgcaggaccagagaattcgaatacaaggcaacannntgcatcaggt

SEQ ID NO: 5002 - DNA, 46 bp, Artificial Sequence
  Synthesized adaptor oligonucleotide
  misc_feature (34)..(36): n is a, c, g, or t
tgcaggaccagagaattcgaatacagacctttcnnntgcatcaggt

SEQ ID NO: 5003 - DNA, 46 bp, Artificial Sequence
  Synthesized adaptor oligonucleotide
  misc_feature (34)..(36): n is a, c, g, or t
tgcaggaccagagaattcgaatacaggaaccaannntgcatcaggt

SEQ ID NO: 5004 - DNA, 46 bp, Artificial Sequence
  Synthesized adaptor oligonucleotide
  misc_feature (34)..(36): n is a, c, g, or t
tgcaggaccagagaattcgaatacacgtgtaacnnntgcatcaggt

SEQ ID NO: 5005 - DNA, 46 bp, Artificial Sequence
  Synthesized adaptor oligonucleotide
  misc_feature (34)..(36): n is a, c, g, or t
tgcaggaccagagaattcgaatacacagatccannntgcatcaggt

SEQ ID NO: 5006 - DNA, 46 bp, Artificial Sequence
  Synthesized adaptor oligonucleotide
  misc_feature (34)..(36): n is a, c, g, or t
tgcaggaccagagaattcgaatacaccagcacgnnntgcatcaggt

SEQ ID NO: 5007 - DNA, 46 bp, Artificial Sequence
  Synthesized adaptor oligonucleotide
  misc_feature (34)..(36): n is a, c, g, or t
tgcaggaccagagaattcgaatacacgagtccgnnntgcatcaggt

SEQ ID NO: 5008 - DNA, 46 bp, Artificial Sequence
  Synthesized adaptor oligonucleotide
  misc_feature (34)..(36): n is a, c, g, or t
tgcaggaccagagaattcgaatacagtcgaatcnnntgcatcaggt

SEQ ID NO: 5009 - DNA, 46 bp, Artificial Sequence
  Synthesized adaptor oligonucleotide
  misc_feature (34)..(36): n is a, c, g, or t
tgcaggaccagagaattcgaatacatccataaannntgcatcaggt

SEQ ID NO: 5010 - DNA, 46 bp, Artificial Sequence
  Synthesized adaptor oligonucleotide
  misc_feature (34)..(36): n is a, c, g, or t
tgcaggaccagagaattcgaatacagtcccaccnnntgcatcaggt

SEQ ID NO: 5011 - DNA, 46 bp, Artificial Sequence
  Synthesized adaptor oligonucleotide
  misc_feature (34)..(36): n is a, c, g, or t
tgcaggaccagagaattcgaatacatggttgacnnntgcatcaggt

SEQ ID NO: 5012 - DNA, 46 bp, Artificial Sequence
  Synthesized adaptor oligonucleotide
  misc_feature (34)..(36): n is a, c, g, or t
tgcaggaccagagaattcgaatacaagacaacgnnntgcatcaggt

SEQ ID NO: 5013 - DNA, 46 bp, Artificial Sequence
  Synthesized adaptor oligonucleotide
  misc_feature (34)..(36): n is a, c, g, or t
tgcaggaccagagaattcgaatacaatattcagnnntgcatcaggt

SEQ ID NO: 5014 - DNA, 46 bp, Artificial Sequence
  Synthesized adaptor oligonucleotide
  misc_feature (34)..(36): n is a, c, g, or t
tgcaggaccagagaattcgaatacagaggaactnnntgcatcaggt

SEQ ID NO: 5015 - DNA, 46 bp, Artificial Sequence
  Synthesized adaptor oligonucleotide
  misc_feature (34)..(36): n is a, c, g, or t
tgcaggaccagagaattcgaatacagaagaaccnnntgcatcaggt

SEQ ID NO: 5016 - DNA, 46 bp, Artificial Sequence
  Synthesized adaptor oligonucleotide
  misc_feature (34)..(36): n is a, c, g, or t
tgcaggaccagagaattcgaatacagcaacaagnnntgcatcaggt

SEQ ID NO: 5017 - DNA, 46 bp, Artificial Sequence
  Synthesized adaptor oligonucleotide
  misc_feature (34)..(36): n is a, c, g, or t
tgcaggaccagagaattcgaatacactaaaccgnnntgcatcaggt

SEQ ID NO: 5018 - DNA, 46 bp, Artificial Sequence
  Synthesized adaptor oligonucleotide
  misc_feature (34)..(36): n is a, c, g, or t
tgcaggaccagagaattcgaatacaggaggtcgnnntgcatcaggt

SEQ ID NO: 5019 - DNA, 46 bp, Artificial Sequence
  Synthesized adaptor oligonucleotide
  misc_feature (34)..(36): n is a, c, g, or t
tgcaggaccagagaattcgaatacacgcgcgtannntgcatcaggt

SEQ ID NO: 5020 - DNA, 46 bp, Artificial Sequence
  Synthesized adaptor oligonucleotide
  misc_feature (34)..(36): n is a, c, g, or t
tgcaggaccagagaattcgaatacaccgagtgcnnntgcatcaggt

SEQ ID NO: 5021 - DNA, 46 bp, Artificial Sequence
  Synthesized adaptor oligonucleotide
  misc_feature (34)..(36): n is a, c, g, or t
tgcaggaccagagaattcgaatacagttcaagcnnntgcatcaggt

SEQ ID NO: 5022 - DNA, 46 bp, Artificial Sequence
  Synthesized adaptor oligonucleotide
  misc_feature (34)..(36): n is a, c, g, or t
tgcaggaccagagaattcgaatacacagcccgannntgcatcaggt

SEQ ID NO: 5023 - DNA, 46 bp, Artificial Sequence
  Synthesized adaptor oligonucleotide
  misc_feature (34)..(36): n is a, c, g, or t
tgcaggaccagagaattcgaatacaccttgactnnntgcatcaggt

SEQ ID NO: 5024 - DNA, 46 bp, Artificial Sequence
  Synthesized adaptor oligonucleotide
  misc_feature (34)..(36): n is a, c, g, or t
tgcaggaccagagaattcgaatacagacgcaaannntgcatcaggt

SEQ ID NO: 5025 - DNA, 46 bp, Artificial Sequence
  Synthesized adaptor oligonucleotide
  misc_feature (34)..(36): n is a, c, g, or t
tgcaggaccagagaattcgaatacatgatcctcnnntgcatcaggt

SEQ ID NO: 5026 - DNA, 46 bp, Artificial Sequence
  Synthesized adaptor oligonucleotide
  misc_feature (34)..(36): n is a, c, g, or t
tgcaggaccagagaattcgaatacaagaaattgnnntgcatcaggt

SEQ ID NO: 5027 - DNA, 46 bp, Artificial Sequence
  Synthesized adaptor oligonucleotide
  misc_feature (34)..(36): n is a, c, g, or t
tgcaggaccagagaattcgaatacagtgtggccnnntgcatcaggt

SEQ ID NO: 5028 - DNA, 46 bp, Artificial Sequence
  Synthesized adaptor oligonucleotide
  misc_feature (34)..(36): n is a, c, g, or t
tgcaggaccagagaattcgaatacacatgtagcnnntgcatcaggt

SEQ ID NO: 5029 - DNA, 46 bp, Artificial Sequence
  Synthesized adaptor oligonucleotide
  misc_feature (34)..(36): n is a, c, g, or t
tgcaggaccagagaattcgaatacatagcccccnnntgcatcaggt

SEQ ID NO: 5030 - DNA, 46 bp, Artificial Sequence
  Synthesized adaptor oligonucleotide
  misc_feature (34)..(36): n is a, c, g, or t
tgcaggaccagagaattcgaatacagtcttgctnnntgcatcaggt

SEQ ID NO: 5031 - DNA, 46 bp, Artificial Sequence
  Synthesized adaptor oligonucleotide
  misc_feature (34)..(36): n is a, c, g, or t
tgcaggaccagagaattcgaatacatgtaagccnnntgcatcaggt

SEQ ID NO: 5032 - DNA, 46 bp, Artificial Sequence
  Synthesized adaptor oligonucleotide
  misc_feature (34)..(36): n is a, c, g, or t
tgcaggaccagagaattcgaatacaacagagacnnntgcatcaggt

SEQ ID NO: 5033 - DNA, 46 bp, Artificial Sequence
  Synthesized adaptor oligonucleotide
  misc_feature (34)..(36): n is a, c, g, or t
tgcaggaccagagaattcgaatacaagttcagcnnntgcatcaggt

SEQ ID NO: 5034 - DNA, 46 bp, Artificial Sequence
  Synthesized adaptor oligonucleotide
  misc_feature (34)..(36): n is a, c, g, or t
tgcaggaccagagaattcgaatacacctgcttannntgcatcaggt

SEQ ID NO: 5035 - DNA, 46 bp, Artificial Sequence
  Synthesized adaptor oligonucleotide
  misc_feature (34)..(36): n is a, c, g, or t
tgcaggaccagagaattcgaatacaacacctctnnntgcatcaggt

SEQ ID NO: 5036 - DNA, 46 bp, Artificial Sequence
  Synthesized adaptor oligonucleotide
  misc_feature (34)..(36): n is a, c, g, or t
tgcaggaccagagaattcgaatacatattgaacnnntgcatcaggt

SEQ ID NO: 5037 - DNA, 46 bp, Artificial Sequence
  Synthesized adaptor oligonucleotide
  misc_feature (34)..(36): n is a, c, g, or t
tgcaggaccagagaattcgaatacagattggtcnnntgcatcaggt

SEQ ID NO: 5038 - DNA, 46 bp, Artificial Sequence
  Synthesized adaptor oligonucleotide
  misc_feature (34)..(36): n is a, c, g, or t
tgcaggaccagagaattcgaatacaaaagaaagnnntgcatcaggt

SEQ ID NO: 5039 - DNA, 46 bp, Artificial Sequence
  Synthesized adaptor oligonucleotide
  misc_feature (34)..(36): n is a, c, g, or t
tgcaggaccagagaattcgaatacataaaaatannntgcatcaggt

SEQ ID NO: 5040 - DNA, 46 bp, Artificial Sequence
  Synthesized adaptor oligonucleotide
  misc_feature (34)..(36): n is a, c, g, or t
tgcaggaccagagaattcgaatacatgtccagannntgcatcaggt

SEQ ID NO: 5041 - DNA, 46 bp, Artificial Sequence
  Synthesized adaptor oligonucleotide
  misc_feature (34)..(36): n is a, c, g, or t
tgcaggaccagagaattcgaatacatttgaggcnnntgcatcaggt

SEQ ID NO: 5042 - DNA, 46 bp, Artificial Sequence
  Synthesized adaptor oligonucleotide
  misc_feature (34)..(36): n is a, c, g, or t
tgcaggaccagagaattcgaatacaccatcctannntgcatcaggt

SEQ ID NO: 5043 - DNA, 46 bp, Artificial Sequence
  Synthesized adaptor oligonucleotide
  misc_feature (34)..(36): n is a, c, g, or t
tgcaggaccagagaattcgaatacactccagaannntgcatcaggt

SEQ ID NO: 5044 - DNA, 46 bp, Artificial Sequence
  Synthesized adaptor oligonucleotide
  misc_feature (34)..(36): n is a, c, g, or t
tgcaggaccagagaattcgaatacacagatggannntgcatcaggt

SEQ ID NO: 5045 - DNA, 46 bp, Artificial Sequence
  Synthesized adaptor oligonucleotide
  misc_feature (34)..(36): n is a, c, g, or t
tgcaggaccagagaattcgaatacataatccccnnntgcatcaggt

SEQ ID NO: 5046 - DNA, 46 bp, Artificial Sequence
  Synthesized adaptor oligonucleotide
  misc_feature (34)..(36): n is a, c, g, or t
tgcaggaccagagaattcgaatacaaggcgctcnnntgcatcaggt

SEQ ID NO: 5047 - DNA, 46 bp, Artificial Sequence
  Synthesized adaptor oligonucleotide
  misc_feature (34)..(36): n is a, c, g, or t
tgcaggaccagagaattcgaatacaattgtcaannntgcatcaggt

SEQ ID NO: 5048 - DNA, 46 bp, Artificial Sequence
  Synthesized adaptor oligonucleotide
  misc_feature (34)..(36): n is a, c, g, or t
tgcaggaccagagaattcgaatacacgcgttaannntgcatcaggt

SEQ ID NO: 5049 - DNA, 46 bp, Artificial Sequence
  Synthesized adaptor oligonucleotide
  misc_feature (34)..(36): n is a, c, g, or t
tgcaggaccagagaattcgaatacattgatgcgnnnacgtatgcca

SEQ ID NO: 5050 - DNA, 46 bp, Artificial Sequence
  Synthesized adaptor oligonucleotide
  misc_feature (34)..(36): n is a, c, g, or t
tgcaggaccagagaattcgaatacaccctacgcnnnacgtatgcca

SEQ ID NO: 5051 - DNA, 46 bp, Artificial Sequence
  Synthesized adaptor oligonucleotide
  misc_feature (34)..(36): n is a, c, g, or t
tgcaggaccagagaattcgaatacagcggcgaannnacgtatgcca

SEQ ID NO: 5052 - DNA, 46 bp, Artificial Sequence
  Synthesized adaptor oligonucleotide
  misc_feature (34)..(36): n is a, c, g, or t
tgcaggaccagagaattcgaatacatagccgcgnnnacgtatgcca

SEQ ID NO: 5053 - DNA, 46 bp, Artificial Sequence
  Synthesized adaptor oligonucleotide
  misc_feature (34)..(36): n is a, c, g, or t
tgcaggaccagagaattcgaatacagaagcgatnnnacgtatgcca

SEQ ID NO: 5054 - DNA, 46 bp, Artificial Sequence
  Synthesized adaptor oligonucleotide
  misc_feature (34)..(36): n is a, c, g, or t
tgcaggaccagagaattcgaatacagacagtgannnacgtatgcca

SEQ ID NO: 5055 - DNA, 46 bp, Artificial Sequence
  Synthesized adaptor oligonucleotide
  misc_feature (34)..(36): n is a, c, g, or t
tgcaggaccagagaattcgaatacactttatcannnacgtatgcca

SEQ ID NO: 5056 - DNA, 46 bp, Artificial Sequence
  Synthesized adaptor oligonucleotide
  misc_feature (34)..(36): n is a, c, g, or t
tgcaggaccagagaattcgaatacacaggaagtnnnacgtatgcca

SEQ ID NO: 5057 - DNA, 46 bp, Artificial Sequence
  Synthesized adaptor oligonucleotide
  misc_feature (34)..(36): n is a, c, g, or t
tgcaggaccagagaattcgaatacagtattggcnnnacgtatgcca

SEQ ID NO: 5058 - DNA, 46 bp, Artificial Sequence
  Synthesized adaptor oligonucleotide
  misc_feature (34)..(36): n is a, c, g, or t
tgcaggaccagagaattcgaatacatcagccggnnnacgtatgcca

SEQ ID NO: 5059 - DNA, 46 bp, Artificial Sequence
  Synthesized adaptor oligonucleotide
  misc_feature (34)..(36): n is a, c, g, or t
tgcaggaccagagaattcgaatacaagcaggatnnnacgtatgcca

SEQ ID NO: 5060 - DNA, 46 bp, Artificial Sequence
  Synthesized adaptor oligonucleotide
  misc_feature (34)..(36): n is a, c, g, or t
tgcaggaccagagaattcgaatacagttagtgcnnnacgtatgcca

SEQ ID NO: 5061 - DNA, 46 bp, Artificial Sequence
  Synthesized adaptor oligonucleotide
  misc_feature (34)..(36): n is a, c, g, or t
tgcaggaccagagaattcgaatacaattgtagtnnnacgtatgcca

SEQ ID NO: 5062 - DNA, 46 bp, Artificial Sequence
  Synthesized adaptor oligonucleotide
  misc_feature (34)..(36): n is a, c, g, or t
tgcaggaccagagaattcgaatacaagcacgttnnnacgtatgcca

SEQ ID NO: 5063 - DNA, 46 bp, Artificial Sequence
  Synthesized adaptor oligonucleotide
  misc_feature (34)..(36): n is a, c, g, or t
tgcaggaccagagaattcgaatacaccccggttnnnacgtatgcca

SEQ ID NO: 5064 - DNA, 46 bp, Artificial Sequence
  Synthesized adaptor oligonucleotide
  misc_feature (34)..(36): n is a, c, g, or t
tgcaggaccagagaattcgaatacaatatctctnnnacgtatgcca

SEQ ID NO: 5065 - DNA, 46 bp, Artificial Sequence
  Synthesized adaptor oligonucleotide
  misc_feature (34)..(36): n is a, c, g, or t
tgcaggaccagagaattcgaatacaatcttcatnnnacgtatgcca

SEQ ID NO: 5066 - DNA, 46 bp, Artificial Sequence
  Synthesized adaptor oligonucleotide
  misc_feature (34)..(36): n is a, c, g, or t
tgcaggaccagagaattcgaatacaggtactcannnacgtatgcca

SEQ ID NO: 5067 - DNA, 46 bp, Artificial Sequence
  Synthesized adaptor oligonucleotide
  misc_feature (34)..(36): n is a, c, g, or t
tgcaggaccagagaattcgaatacaccacctatnnnacgtatgcca

SEQ ID NO: 5068 - DNA, 46 bp, Artificial Sequence
  Synthesized adaptor oligonucleotide
  misc_feature (34)..(36): n is a, c, g, or t
tgcaggaccagagaattcgaatacaataataaannnacgtatgcca

SEQ ID NO: 5069 - DNA, 46 bp, Artificial Sequence
  Synthesized adaptor oligonucleotide
  misc_feature (34)..(36): n is a, c, g, or t
tgcaggaccagagaattcgaatacaacataatcnnnacgtatgcca

SEQ ID NO: 5070 - DNA, 46 bp, Artificial Sequence
  Synthesized adaptor oligonucleotide
  misc_feature (34)..(36): n is a, c, g, or t
tgcaggaccagagaattcgaatacaccttcgtannnacgtatgcca

SEQ ID NO: 5071 - DNA, 46 bp, Artificial Sequence
  Synthesized adaptor oligonucleotide
  misc_feature (34)..(36): n is a, c, g, or t
tgcaggaccagagaattcgaatacaggatcttgnnnacgtatgcca

SEQ ID NO: 5072 - DNA, 46 bp, Artificial Sequence
  Synthesized adaptor oligonucleotide
  misc_feature (34)..(36): n is a, c, g, or t
tgcaggaccagagaattcgaatacagaggcggtnnnacgtatgcca

SEQ ID NO: 5073 - DNA, 46 bp, Artificial Sequence
  Synthesized adaptor oligonucleotide
  misc_feature (34)..(36): n is a, c, g, or t
tgcaggaccagagaattcgaatacactcaaaatnnnacgtatgcca

SEQ ID NO: 5074 - DNA, 46 bp, Artificial Sequence
  Synthesized adaptor oligonucleotide
  misc_feature (34)..(36): n is a, c, g, or t
tgcaggaccagagaattcgaatacacaactgcannnacgtatgcca

SEQ ID NO: 5075 - DNA, 46 bp, Artificial Sequence
  Synthesized adaptor oligonucleotide
  misc_feature (34)..(36): n is a, c, g, or t
tgcaggaccagagaattcgaatacacggttcccnnnacgtatgcca

SEQ ID NO: 5076 - DNA, 46 bp, Artificial Sequence
  Synthesized adaptor oligonucleotide
  misc_feature (34)..(36): n is a, c, g, or t
tgcaggaccagagaattcgaatacagtggtagannnacgtatgcca

SEQ ID NO: 5077 - DNA, 46 bp, Artificial Sequence
  Synthesized adaptor oligonucleotide
  misc_feature (34)..(36): n is a, c, g, or t
tgcaggaccagagaattcgaatacatctgagtgnnnacgtatgcca

SEQ ID NO: 5078 - DNA, 46 bp, Artificial Sequence
  Synthesized adaptor oligonucleotide
  misc_feature (34)..(36): n is a, c, g, or t
tgcaggaccagagaattcgaatacacagcctttnnnacgtatgcca

SEQ ID NO: 5079 - DNA, 46 bp, Artificial Sequence
  Synthesized adaptor oligonucleotide
  misc_feature (34)..(36): n is a, c, g, or t
tgcaggaccagagaattcgaatacagtgtgttgnnnacgtatgcca

SEQ ID NO: 5080 - DNA, 46 bp, Artificial Sequence
  Synthesized adaptor oligonucleotide
  misc_feature (34)..(36): n is a, c, g, or t
tgcaggaccagagaattcgaatacaattgtaacnnnacgtatgcca

SEQ ID NO: 5081 - DNA, 46 bp, Artificial Sequence
  Synthesized adaptor oligonucleotide
  misc_feature (34)..(36): n is a, c, g, or t
tgcaggaccagagaattcgaatacaaagttcatnnnacgtatgcca

SEQ ID NO: 5082 - DNA, 46 bp, Artificial Sequence
  Synthesized adaptor oligonucleotide
  misc_feature (34)..(36): n is a, c, g, or t
tgcaggaccagagaattcgaatacaaagtcgctnnnacgtatgcca

SEQ ID NO: 5083 - DNA, 46 bp, Artificial Sequence
  Synthesized adaptor oligonucleotide
  misc_feature (34)..(36): n is a, c, g, or t
tgcaggaccagagaattcgaatacaatatcagtnnnacgtatgcca

SEQ ID NO: 5084 - DNA, 46 bp, Artificial Sequence
  Synthesized adaptor oligonucleotide
  misc_feature (34)..(36): n is a, c, g, or t
tgcaggaccagagaattcgaatacattctccgannnacgtatgcca

SEQ ID NO: 5085 - DNA, 46 bp, Artificial Sequence
  Synthesized adaptor oligonucleotide
  misc_feature (34)..(36): n is a, c, g, or t
tgcaggaccagagaattcgaatacatcttgaaannnacgtatgcca

SEQ ID NO: 5086 - DNA, 46 bp, Artificial Sequence
  Synthesized adaptor oligonucleotide
  misc_feature (34)..(36): n is a, c, g, or t
tgcaggaccagagaattcgaatacattaccgagnnnacgtatgcca

SEQ ID NO: 5087 - DNA, 46 bp, Artificial Sequence
  Synthesized adaptor oligonucleotide
  misc_feature (34)..(36): n is a, c, g, or t
tgcaggaccagagaattcgaatacaacttagatnnnacgtatgcca

SEQ ID NO: 5088 - DNA, 46 bp, Artificial Sequence
  Synthesized adaptor oligonucleotide
  misc_feature (34)..(36): n is a, c, g, or t
tgcaggaccagagaattcgaatacacatcggtannnacgtatgcca

SEQ ID NO: 5089 - DNA, 46 bp, Artificial Sequence
  Synthesized adaptor oligonucleotide
  misc_feature (34)..(36): n is a, c, g, or t
tgcaggaccagagaattcgaatacaccagcgcannnacgtatgcca

SEQ ID NO: 5090 - DNA, 46 bp, Artificial Sequence
  Synthesized adaptor oligonucleotide
  misc_feature (34)..(36): n is a, c, g, or t
tgcaggaccagagaattcgaatacatatcgatannnacgtatgcca

SEQ ID NO: 5091 - DNA, 46 bp, Artificial Sequence
  Synthesized adaptor oligonucleotide
  misc_feature (34)..(36): n is a, c, g, or t
tgcaggaccagagaattcgaatacaagactctgnnnacgtatgcca

SEQ ID NO: 5092 - DNA, 46 bp, Artificial Sequence
  Synthesized adaptor oligonucleotide
  misc_feature (34)..(36): n is a, c, g, or t
tgcaggaccagagaattcgaatacaagagcacannnacgtatgcca

SEQ ID NO: 5093 - DNA, 46 bp, Artificial Sequence
  Synthesized adaptor oligonucleotide
  misc_feature (34)..(36): n is a, c, g, or t
tgcaggaccagagaattcgaatacataccgtagnnnacgtatgcca

SEQ ID NO: 5094 - DNA, 46 bp, Artificial Sequence
  Synthesized adaptor oligonucleotide
  misc_feature (34)..(36): n is a, c, g, or t
tgcaggaccagagaattcgaatacagaaggtgtnnnacgtatgcca

SEQ ID NO: 5095 - DNA, 46 bp, Artificial Sequence
  Synthesized adaptor oligonucleotide
  misc_feature (34)..(36): n is a, c, g, or t
tgcaggaccagagaattcgaatacattggaccannnacgtatgcca

SEQ ID NO: 5096 - DNA, 46 bp, Artificial Sequence
  Synthesized adaptor oligonucleotide
  misc_feature (34)..(36): n is a, c, g, or t
tgcaggaccagagaattcgaatacagcaatcacnnnacgtatgcca

SEQ ID NO: 5097 - DNA, 46 bp, Artificial Sequence
  Synthesized adaptor oligonucleotide
  misc_feature (34)..(36): n is a, c, g, or t
tgcaggaccagagaattcgaatacattgagcgtnnnacgtatgcca

SEQ ID NO: 5098 - DNA, 46 bp, Artificial Sequence
  Synthesized adaptor oligonucleotide
  misc_feature (34)..(36): n is a, c, g, or t
tgcaggaccagagaattcgaatacacaagtgtcnnnacgtatgcca

SEQ ID NO: 5099 - DNA, 46 bp, Artificial Sequence
  Synthesized adaptor oligonucleotide
  misc_feature (34)..(36): n is a, c, g, or t
tgcaggaccagagaattcgaatacagtctaatannnacgtatgcca

SEQ ID NO: 5100 - DNA, 46 bp, Artificial Sequence
  Synthesized adaptor oligonucleotide
  misc_feature (34)..(36): n is a, c, g, or t
tgcaggaccagagaattcgaatacaaagaaatcnnnacgtatgcca

SEQ ID NO: 5101 - DNA, 46 bp, Artificial Sequence
  Synthesized adaptor oligonucleotide
  misc_feature (34)..(36): n is a, c, g, or t
tgcaggaccagagaattcgaatacagctagatcnnnacgtatgcca

SEQ ID NO: 5102 - DNA, 46 bp, Artificial Sequence
  Synthesized adaptor oligonucleotide
  misc_feature (34)..(36): n is a, c, g, or t
tgcaggaccagagaattcgaatacagataagtannnacgtatgcca

SEQ ID NO: 5103 - DNA, 46 bp, Artificial Sequence
  Synthesized adaptor oligonucleotide
  misc_feature (34)..(36): n is a, c, g, or t
tgcaggaccagagaattcgaatacaggttcagtnnnacgtatgcca

SEQ ID NO: 5104 - DNA, 46 bp, Artificial Sequence
  Synthesized adaptor oligonucleotide
  misc_feature (34)..(36): n is a, c, g, or t
tgcaggaccagagaattcgaatacaagctgactnnnacgtatgcca

SEQ ID NO: 5105 - DNA, 46 bp, Artificial Sequence
  Synthesized adaptor oligonucleotide
  misc_feature (34)..(36): n is a, c, g, or t
tgcaggaccagagaattcgaatacatgcgccagnnnacgtatgcca

SEQ ID NO: 5106 - DNA, 46 bp, Artificial Sequence
  Synthesized adaptor oligonucleotide
  misc_feature (34)..(36): n is a, c, g, or t
tgcaggaccagagaattcgaatacatgtcagtgnnnacgtatgcca

SEQ ID NO: 5107 - DNA, 46 bp, Artificial Sequence
  Synthesized adaptor oligonucleotide
  misc_feature (34)..(36): n is a, c, g, or t
tgcaggaccagagaattcgaatacagaatcgtcnnnacgtatgcca

SEQ ID NO: 5108 - DNA, 46 bp, Artificial Sequence
  Synthesized adaptor oligonucleotide
  misc_feature (34)..(36): n is a, c, g, or t
tgcaggaccagagaattcgaatacaccccatgcnnnacgtatgcca

SEQ ID NO: 5109 - DNA, 46 bp, Artificial Sequence
  Synthesized adaptor oligonucleotide
  misc_feature (34)..(36): n is a, c, g, or t
tgcaggaccagagaattcgaatacacattagcgnnnctagcgttac

SEQ ID NO: 5110 - DNA, 46 bp, Artificial Sequence
  Synthesized adaptor oligonucleotide
  misc_feature (34)..(36): n is a, c, g, or t
tgcaggaccagagaattcgaatacaatccacctnnnctagcgttac

SEQ ID NO: 5111 - DNA, 46 bp, Artificial Sequence
  Synthesized adaptor oligonucleotide
  misc_feature (34)..(36): n is a, c, g, or t
tgcaggaccagagaattcgaatacaacatgcgtnnnctagcgttac

SEQ ID NO: 5112 - DNA, 46 bp, Artificial Sequence
  Synthesized adaptor oligonucleotide
  misc_feature (34)..(36): n is a, c, g, or t
tgcaggaccagagaattcgaatacagctttaccnnnctagcgttac

SEQ ID NO: 5113 - DNA, 46 bp, Artificial Sequence
  Synthesized adaptor oligonucleotide
  misc_feature (34)..(36): n is a, c, g, or t
tgcaggaccagagaattcgaatacaaacctcctnnnctagcgttac

SEQ ID NO: 5114 - DNA, 46 bp, Artificial Sequence
  Synthesized adaptor oligonucleotide
  misc_feature (34)..(36): n is a, c, g, or t
tgcaggaccagagaattcgaatacactttatgtnnnctagcgttac

SEQ ID NO: 5115 - DNA, 46 bp, Artificial Sequence
  Synthesized adaptor oligonucleotide
  misc_feature (34)..(36): n is a, c, g, or t
tgcaggaccagagaattcgaatacactcgcctgnnnctagcgttac

SEQ ID NO: 5116 - DNA, 46 bp, Artificial Sequence
  Synthesized adaptor oligonucleotide
  misc_feature (34)..(36): n is a, c, g, or t
tgcaggaccagagaattcgaatacaatgatgttnnnctagcgttac

SEQ ID NO: 5117 - DNA, 46 bp, Artificial Sequence
  Synthesized adaptor oligonucleotide
  misc_feature (34)..(36): n is a, c, g, or t
tgcaggaccagagaattcgaatacagagttggannnctagcgttac

SEQ ID NO: 5118 - DNA, 46 bp, Artificial Sequence
  Synthesized adaptor oligonucleotide
  misc_feature (34)..(36): n is a, c, g, or t
tgcaggaccagagaattcgaatacaacaaccacnnnctagcgttac

SEQ ID NO: 5119 - DNA, 46 bp, Artificial Sequence
  Synthesized adaptor oligonucleotide
  misc_feature (34)..(36): n is a, c, g, or t
tgcaggaccagagaattcgaatacataccgcaannnctagcgttac

SEQ ID NO: 5120 - DNA, 46 bp, Artificial Sequence
  Synthesized adaptor oligonucleotide
  misc_feature (34)..(36): n is a, c, g, or t
tgcaggaccagagaattcgaatacaggttaaaannnctagcgttac

SEQ ID NO: 5121 - DNA, 46 bp, Artificial Sequence
  Synthesized adaptor oligonucleotide
  misc_feature (34)..(36): n is a, c, g, or t
tgcaggaccagagaattcgaatacacggaaagtnnnctagcgttac

SEQ ID NO: 5122 - DNA, 46 bp, Artificial Sequence
  Synthesized adaptor oligonucleotide
  misc_feature (34)..(36): n is a, c, g, or t
tgcaggaccagagaattcgaatacagtggtccgnnnctagcgttac

SEQ ID NO: 5123 - DNA, 46 bp, Artificial Sequence
  Synthesized adaptor oligonucleotide
  misc_feature (34)..(36): n is a, c, g, or t
tgcaggaccagagaattcgaatacaggtgtccgnnnctagcgttac

SEQ ID NO: 5124 - DNA, 46 bp, Artificial Sequence
  Synthesized adaptor oligonucleotide
  misc_feature (34)..(36): n is a, c, g, or t
tgcaggaccagagaattcgaatacatcgcacttnnnctagcgttac

SEQ ID NO: 5125 - DNA, 46 bp, Artificial Sequence
  Synthesized adaptor oligonucleotide
  misc_feature (34)..(36): n is a, c, g, or t
tgcaggaccagagaattcgaatacattcggtctnnnctagcgttac

SEQ ID NO: 5126 - DNA, 46 bp, Artificial Sequence
  Synthesized adaptor oligonucleotide
  misc_feature (34)..(36): n is a, c, g, or t
tgcaggaccagagaattcgaatacaacgaggatnnnctagcgttac

SEQ ID NO: 5127 - DNA, 46 bp, Artificial Sequence
  Synthesized adaptor oligonucleotide
  misc_feature (34)..(36): n is a, c, g, or t
tgcaggaccagagaattcgaatacagtagatggnnnctagcgttac

SEQ ID NO: 5128 - DNA, 46 bp, Artificial Sequence
  Synthesized adaptor oligonucleotide
  misc_feature (34)..(36): n is a, c, g, or t
tgcaggaccagagaattcgaatacaccacacttnnnctagcgttac

SEQ ID NO: 5129 - DNA, 46 bp, Artificial Sequence
  Synthesized adaptor oligonucleotide
  misc_feature (34)..(36): n is a, c, g, or t
tgcaggaccagagaattcgaatacagtttgcgannnctagcgttac

SEQ ID NO: 5130 - DNA, 46 bp, Artificial Sequence
  Synthesized adaptor oligonucleotide
  misc_feature (34)..(36): n is a, c, g, or t
tgcaggaccagagaattcgaatacaacggtatcnnnctagcgttac

SEQ ID NO: 5131 - DNA, 46 bp, Artificial Sequence
  Synthesized adaptor oligonucleotide
  misc_feature (34)..(36): n is a, c, g, or t
tgcaggaccagagaattcgaatacaatgatagannnctagcgttac

SEQ ID NO: 5132 - DNA, 46 bp, Artificial Sequence
  Synthesized adaptor oligonucleotide
  misc_feature (34)..(36): n is a, c, g, or t
tgcaggaccagagaattcgaatacacaataactnnnctagcgttac

SEQ ID NO: 5133 - DNA, 46 bp, Artificial Sequence
  Synthesized adaptor oligonucleotide
  misc_feature (34)..(36): n is a, c, g, or t
tgcaggaccagagaattcgaatacagatcctagnnnctagcgttac

SEQ ID NO: 5134 - DNA, 46 bp, Artificial Sequence
  Synthesized adaptor oligonucleotide
  misc_feature (34)..(36): n is a, c, g, or t
tgcaggaccagagaattcgaatacaattaccccnnnctagcgttac

SEQ ID NO: 5135 - DNA, 46 bp, Artificial Sequence
  Synthesized adaptor oligonucleotide
  misc_feature (34)..(36): n is a, c, g, or t
tgcaggaccagagaattcgaatacactgtgcggnnnctagcgttac

SEQ ID NO: 5136 - DNA, 46 bp, Artificial Sequence
  Synthesized adaptor oligonucleotide
  misc_feature (34)..(36): n is a, c, g, or t
tgcaggaccagagaattcgaatacatatgtgtannnctagcgttac

SEQ ID NO: 5137 - DNA, 46 bp, Artificial Sequence
  Synthesized adaptor oligonucleotide
  misc_feature (34)..(36): n is a, c, g, or t
tgcaggaccagagaattcgaatacagctccttannnctagcgttac

SEQ ID NO: 5138 - DNA, 46 bp, Artificial Sequence
  Synthesized adaptor oligonucleotide
  misc_feature (34)..(36): n is a, c, g, or t
tgcaggaccagagaattcgaatacaaaaagcgcnnnctagcgttac

SEQ ID NO: 5139 - DNA, 46 bp, Artificial Sequence
  Synthesized adaptor oligonucleotide
  misc_feature (34)..(36): n is a, c, g, or t
tgcaggaccagagaattcgaatacatggtatatnnnctagcgttac

SEQ ID NO: 5140 - DNA, 46 bp, Artificial Sequence
  Synthesized adaptor oligonucleotide
  misc_feature (34)..(36): n is a, c, g, or t
tgcaggaccagagaattcgaatacacatcacgannnctagcgttac

SEQ ID NO: 5141 - DNA, 46 bp, Artificial Sequence
  Synthesized adaptor oligonucleotide
  misc_feature (34)..(36): n is a, c, g, or t
tgcaggaccagagaattcgaatacactcattcgnnnctagcgttac

SEQ ID NO: 5142 - DNA, 46 bp, Artificial Sequence
  Synthesized adaptor oligonucleotide
  misc_feature (34)..(36): n is a, c, g, or t
tgcaggaccagagaattcgaatacaggcgcatcnnnctagcgttac

SEQ ID NO: 5143 - DNA, 46 bp, Artificial Sequence
  Synthesized adaptor oligonucleotide
  misc_feature (34)..(36): n is a, c, g, or t
tgcaggaccagagaattcgaatacaaaagattgnnnctagcgttac

SEQ ID NO: 5144 - DNA, 46 bp, Artificial Sequence
  Synthesized adaptor oligonucleotide
  misc_feature (34)..(36): n is a, c, g, or t
tgcaggaccagagaattcgaatacatgaaagatnnnctagcgttac

SEQ ID NO: 5145 - DNA, 46 bp, Artificial Sequence
  Synthesized adaptor oligonucleotide
  misc_feature (34)..(36): n is a, c, g, or t
tgcaggaccagagaattcgaatacacaggcttannnctagcgttac

SEQ ID NO: 5146 - DNA, 46 bp, Artificial Sequence
  Synthesized adaptor oligonucleotide
  misc_feature (34)..(36): n is a, c, g, or t
tgcaggaccagagaattcgaatacacgaattcgnnnctagcgttac

SEQ ID NO: 5147 - DNA, 46 bp, Artificial Sequence
  Synthesized adaptor oligonucleotide
  misc_feature (34)..(36): n is a, c, g, or t
tgcaggaccagagaattcgaatacataaccacgnnnctagcgttac

SEQ ID NO: 5148 - DNA, 46 bp, Artificial Sequence
  Synthesized adaptor oligonucleotide
  misc_feature (34)..(36): n is a, c, g, or t
tgcaggaccagagaattcgaatacaagcaggtannnctagcgttac

SEQ ID NO: 5149 - DNA, 46 bp, Artificial Sequence
  Synthesized adaptor oligonucleotide
  misc_feature (34)..(36): n is a, c, g, or t
tgcaggaccagagaattcgaatacacacaaggannnctagcgttac

SEQ ID NO: 5150 - DNA, 46 bp, Artificial Sequence
  Synthesized adaptor oligonucleotide
  misc_feature (34)..(36): n is a, c, g, or t
tgcaggaccagagaattcgaatacaactagccannnctagcgttac

SEQ ID NO: 5151 - DNA, 46 bp, Artificial Sequence
  Synthesized adaptor oligonucleotide
  misc_feature (34)..(36): n is a, c, g, or t
tgcaggaccagagaattcgaatacacacgtggcnnnctagcgttac

SEQ ID NO: 5152 - DNA, 46 bp, Artificial Sequence
  Synthesized adaptor oligonucleotide
  misc_feature (34)..(36): n is a, c, g, or t
tgcaggaccagagaattcgaatacaccagtcggnnnctagcgttac

SEQ ID NO: 5153 - DNA, 46 bp, Artificial Sequence
  Synthesized adaptor oligonucleotide
  misc_feature (34)..(36): n is a, c, g, or t
tgcaggaccagagaattcgaatacacacccctgnnnctagcgttac

SEQ ID NO: 5154 - DNA, 46 bp, Artificial Sequence
  Synthesized adaptor oligonucleotide
  misc_feature (34)..(36): n is a, c, g, or t
tgcaggaccagagaattcgaatacacaatacatnnnctagcgttac

SEQ ID NO: 5155 - DNA, 46 bp, Artificial Sequence
  Synthesized adaptor oligonucleotide
  misc_feature (34)..(36): n is a, c, g, or t
tgcaggaccagagaattcgaatacactgcatagnnnctagcgttac

SEQ ID NO: 5156 - DNA, 46 bp, Artificial Sequence
  Synthesized adaptor oligonucleotide
  misc_feature (34)..(36): n is a, c, g, or t
tgcaggaccagagaattcgaatacactgaaaaannnctagcgttac

SEQ ID NO: 5157 - DNA, 46 bp, Artificial Sequence
  Synthesized adaptor oligonucleotide
  misc_feature (34)..(36): n is a, c, g, or t
tgcaggaccagagaattcgaatacagtccattcnnnctagcgttac

SEQ ID NO: 5158 - DNA, 46 bp, Artificial Sequence
  Synthesized adaptor oligonucleotide
  misc_feature (34)..(36): n is a, c, g, or t
tgcaggaccagagaattcgaatacattagtggcnnnctagcgttac

SEQ ID NO: 5159 - DNA, 46 bp, Artificial Sequence
  Synthesized adaptor oligonucleotide
  misc_feature (34)..(36): n is a, c, g, or t
tgcaggaccagagaattcgaatacaactggcatnnnctagcgttac

SEQ ID NO: 5160 - DNA, 46 bp, Artificial Sequence
  Synthesized adaptor oligonucleotide
  misc_feature (34)..(36): n is a, c, g, or t
tgcaggaccagagaattcgaatacaatggttgcnnnctagcgttac

SEQ ID NO: 5161 - DNA, 46 bp, Artificial Sequence
  Synthesized adaptor oligonucleotide
  misc_feature (34)..(36): n is a, c, g, or t
tgcaggaccagagaattcgaatacatggctcccnnnctagcgttac

SEQ ID NO: 5162 - DNA, 46 bp, Artificial Sequence
  Synthesized adaptor oligonucleotide
  misc_feature (34)..(36): n is a, c, g, or t
tgcaggaccagagaattcgaatacagatttttcnnnctagcgttac

SEQ ID NO: 5163 - DNA, 46 bp, Artificial Sequence
  Synthesized adaptor oligonucleotide
  misc_feature (34)..(36): n is a, c, g, or t
tgcaggaccagagaattcgaatacagcctacaannnctagcgttac

SEQ ID NO: 5164 - DNA, 46 bp, Artificial Sequence
  Synthesized adaptor oligonucleotide
  misc_feature (34)..(36): n is a, c, g, or t
tgcaggaccagagaattcgaatacaggattcacnnnctagcgttac

SEQ ID NO: 5165 - DNA, 46 bp, Artificial Sequence
  Synthesized adaptor oligonucleotide
  misc_feature (34)..(36): n is a, c, g, or t
tgcaggaccagagaattcgaatacaattcgcagnnnctagcgttac

SEQ ID NO: 5166 - DNA, 46 bp, Artificial Sequence
  Synthesized adaptor oligonucleotide
  misc_feature (34)..(36): n is a, c, g, or t
tgcaggaccagagaattcgaatacacggctacgnnnctagcgttac

SEQ ID NO: 5167 - DNA, 46 bp, Artificial Sequence
  Synthesized adaptor oligonucleotide
  misc_feature (34)..(36): n is a, c, g, or t
tgcaggaccagagaattcgaatacaatcctaggnnnctagcgttac

SEQ ID NO: 5168 - DNA, 46 bp, Artificial Sequence
  Synthesized adaptor oligonucleotide
  misc_feature (34)..(36): n is a, c, g, or t
tgcaggaccagagaattcgaatacatcgtacctnnnctagcgttac

SEQ ID NO: 5169 - DNA, 46 bp, Artificial Sequence
  Synthesized adaptor oligonucleotide
  misc_feature (34)..(36): n is a, c, g, or t
tgcaggaccagagaattcgaatacacatctaaannngatcgacatg

SEQ ID NO: 5170 - DNA, 46 bp, Artificial Sequence
  Synthesized adaptor oligonucleotide
  misc_feature (34)..(36): n is a, c, g, or t
tgcaggaccagagaattcgaatacaagtgaacgnnngatcgacatg

SEQ ID NO: 5171 - DNA, 46 bp, Artificial Sequence
  Synthesized adaptor oligonucleotide
  misc_feature (34)..(36): n is a, c, g, or t
tgcaggaccagagaattcgaatacactgaactgnnngatcgacatg

SEQ ID NO: 5172 - DNA, 46 bp, Artificial Sequence
  Synthesized adaptor oligonucleotide
  misc_feature (34)..(36): n is a, c, g, or t
tgcaggaccagagaattcgaatacagatacgagnnngatcgacatg

SEQ ID NO: 5173 - DNA, 46 bp, Artificial Sequence
  Synthesized adaptor oligonucleotide
  misc_feature (34)..(36): n is a, c, g, or t
tgcaggaccagagaattcgaatacatttcctaannngatcgacatg

SEQ ID NO: 5174 - DNA, 46 bp, Artificial Sequence
  Synthesized adaptor oligonucleotide
  misc_feature (34)..(36): n is a, c, g, or t
tgcaggaccagagaattcgaatacatagtctttnnngatcgacatg

SEQ ID NO: 5175 - DNA, 46 bp, Artificial Sequence
  Synthesized adaptor oligonucleotide
  misc_feature (34)..(36): n is a, c, g, or t
tgcaggaccagagaattcgaatacaagttgccannngatcgacatg

SEQ ID NO: 5176 - DNA, 46 bp, Artificial Sequence
  Synthesized adaptor oligonucleotide
  misc_feature (34)..(36): n is a, c, g, or t
tgcaggaccagagaattcgaatacaagcgacaannngatcgacatg

SEQ ID NO: 5177 - DNA, 46 bp, Artificial Sequence
  Synthesized adaptor oligonucleotide
  misc_feature (34)..(36): n is a, c, g, or t
tgcaggaccagagaattcgaatacaggataaatnnngatcgacatg

SEQ ID NO: 5178 - DNA, 46 bp, Artificial Sequence
  Synthesized adaptor oligonucleotide
  misc_feature (34)..(36): n is a, c, g, or t
tgcaggaccagagaattcgaatacatttgaaacnnngatcgacatg

SEQ ID NO: 5179 - DNA, 46 bp, Artificial Sequence
  Synthesized adaptor oligonucleotide
  misc_feature (34)..(36): n is a, c, g, or t
tgcaggaccagagaattcgaatacagaggatacnnngatcgacatg

SEQ ID NO: 5180 - DNA, 46 bp, Artificial Sequence
  Synthesized adaptor oligonucleotide
  misc_feature (34)..(36): n is a, c, g, or t
tgcaggaccagagaattcgaatacaactggatcnnngatcgacatg

SEQ ID NO: 5181 - DNA, 46 bp, Artificial Sequence
  Synthesized adaptor oligonucleotide
  misc_feature (34)..(36): n is a, c, g, or t
tgcaggaccagagaattcgaatacaaaatggatnnngatcgacatg

SEQ ID NO: 5182 - DNA, 46 bp, Artificial Sequence
  Synthesized adaptor oligonucleotide
  misc_feature (34)..(36): n is a, c, g, or t
tgcaggaccagagaattcgaatacacgcatgatnnngatcgacatg

SEQ ID NO: 5183 - DNA, 46 bp, Artificial Sequence
  Synthesized adaptor oligonucleotide
  misc_feature (34)..(36): n is a, c, g, or t
tgcaggaccagagaattcgaatacatacgaattnnngatcgacatg

SEQ ID NO: 5184 - DNA, 46 bp, Artificial Sequence
  Synthesized adaptor oligonucleotide
  misc_feature (34)..(36): n is a, c, g, or t
tgcaggaccagagaattcgaatacaggaaagctnnngatcgacatg

SEQ ID NO: 5185 - DNA, 46 bp, Artificial Sequence
  Synthesized adaptor oligonucleotide
  misc_feature (34)..(36): n is a, c, g, or t
tgcaggaccagagaattcgaatacaccaacaacnnngatcgacatg

SEQ ID NO: 5186 - DNA, 46 bp, Artificial Sequence
  Synthesized adaptor oligonucleotide
  misc_feature (34)..(36): n is a, c, g, or t
tgcaggaccagagaattcgaatacaacgcgaccnnngatcgacatg

SEQ ID NO: 5187 - DNA, 46 bp, Artificial Sequence
  Synthesized adaptor oligonucleotide
  misc_feature (34)..(36): n is a, c, g, or t
tgcaggaccagagaattcgaatacaggagtcccnnngatcgacatg

SEQ ID NO: 5188 - DNA, 46 bp, Artificial Sequence
  Synthesized adaptor oligonucleotide
  misc_feature (34)..(36): n is a, c, g, or t
tgcaggaccagagaattcgaatacaccacgcagnnngatcgacatg

SEQ ID NO: 5189 - DNA, 46 bp, Artificial Sequence
  Synthesized adaptor oligonucleotide
  misc_feature (34)..(36): n is a, c, g, or t
tgcaggaccagagaattcgaatacaactcgcccnnngatcgacatg

SEQ ID NO: 5190 - DNA, 46 bp, Artificial Sequence
  Synthesized adaptor oligonucleotide
  misc_feature (34)..(36): n is a, c, g, or t
tgcaggaccagagaattcgaatacactgaagagnnngatcgacatg

SEQ ID NO: 5191 - DNA, 46 bp, Artificial Sequence
  Synthesized adaptor oligonucleotide
  misc_feature (34)..(36): n is a, c, g, or t
tgcaggaccagagaattcgaatacaggagcacgnnngatcgacatg

SEQ ID NO: 5192 - DNA, 46 bp, Artificial Sequence
  Synthesized adaptor oligonucleotide
  misc_feature (34)..(36): n is a, c, g, or t
tgcaggaccagagaattcgaatacaggagcgacnnngatcgacatg

SEQ ID NO: 5193 - DNA, 46 bp, Artificial Sequence
  Synthesized adaptor oligonucleotide
  misc_feature (34)..(36): n is a, c, g, or t
tgcaggaccagagaattcgaatacaggaaccttnnngatcgacatg

SEQ ID NO: 5194 - DNA, 46 bp, Artificial Sequence
  Synthesized adaptor oligonucleotide
  misc_feature (34)..(36): n is a, c, g, or t
tgcaggaccagagaattcgaatacagccctgtcnnngatcgacatg

SEQ ID NO: 5195 - DNA, 46 bp, Artificial Sequence
  Synthesized adaptor oligonucleotide
  misc_feature (34)..(36): n is a, c, g, or t
tgcaggaccagagaattcgaatacaagtaatctnnngatcgacatg

SEQ ID NO: 5196 - DNA, 46 bp, Artificial Sequence
  Synthesized adaptor oligonucleotide
  misc_feature (34)..(36): n is a, c, g, or t
tgcaggaccagagaattcgaatacacgctcgagnnngatcgacatg

SEQ ID NO: 5197 - DNA, 46 bp, Artificial Sequence
  Synthesized adaptor oligonucleotide
  misc_feature (34)..(36): n is a, c, g, or t
tgcaggaccagagaattcgaatacagtcatggtnnngatcgacatg

SEQ ID NO: 5198 - DNA, 46 bp, Artificial Sequence
  Synthesized adaptor oligonucleotide
  misc_feature (34)..(36): n is a, c, g, or t
tgcaggaccagagaattcgaatacagattccagnnngatcgacatg

SEQ ID NO: 5199 - DNA, 46 bp, Artificial Sequence
  Synthesized adaptor oligonucleotide
  misc_feature (34)..(36): n is a, c, g, or t
tgcaggaccagagaattcgaatacactattactnnngatcgacatg

SEQ ID NO: 5200 - DNA, 46 bp, Artificial Sequence
  Synthesized adaptor oligonucleotide
  misc_feature (34)..(36): n is a, c, g, or t
tgcaggaccagagaattcgaatacaaggtctacnnngatcgacatg

SEQ ID NO: 5201 - DNA, 46 bp, Artificial Sequence
  Synthesized adaptor oligonucleotide
  misc_feature (34)..(36): n is a, c, g, or t
tgcaggaccagagaattcgaatacacctgtagannngatcgacatg

SEQ ID NO: 5202 - DNA, 46 bp, Artificial Sequence
  Synthesized adaptor oligonucleotide
  misc_feature (34)..(36): n is a, c, g, or t
tgcaggaccagagaattcgaatacatcctgtcannngatcgacatg

SEQ ID NO: 5203 - DNA, 46 bp, Artificial Sequence
  Synthesized adaptor oligonucleotide
  misc_feature (34)..(36): n is a, c, g, or t
tgcaggaccagagaattcgaatacaccctgcgtnnngatcgacatg

SEQ ID NO: 5204 - DNA, 46 bp, Artificial Sequence
  Synthesized adaptor oligonucleotide
  misc_feature (34)..(36): n is a, c, g, or t
tgcaggaccagagaattcgaatacaacaatgaannngatcgacatg

SEQ ID NO: 5205 - DNA, 46 bp, Artificial Sequence
  Synthesized adaptor oligonucleotide
  misc_feature (34)..(36): n is a, c, g, or t
tgcaggaccagagaattcgaatacaggtggagcnnngatcgacatg

SEQ ID NO: 5206 - DNA, 46 bp, Artificial Sequence
  Synthesized adaptor oligonucleotide
  misc_feature (34)..(36): n is a, c, g, or t
tgcaggaccagagaattcgaatacaggatagacnnngatcgacatg

SEQ ID NO: 5207 - DNA, 46 bp, Artificial Sequence
  Synthesized adaptor oligonucleotide
  misc_feature (34)..(36): n is a, c, g, or t
tgcaggaccagagaattcgaatacagagtgcccnnngatcgacatg

SEQ ID NO: 5208 - DNA, 46 bp, Artificial Sequence
  Synthesized adaptor oligonucleotide
  misc_feature (34)..(36): n is a, c, g, or t
tgcaggaccagagaattcgaatacaaaacggtgnnngatcgacatg

SEQ ID NO: 5209 - DNA, 46 bp, Artificial Sequence
  Synthesized adaptor oligonucleotide
  misc_feature (34)..(36): n is a, c, g, or t
tgcaggaccagagaattcgaatacaaatagcaannngatcgacatg

SEQ ID NO: 5210 - DNA, 46 bp, Artificial Sequence
  Synthesized adaptor oligonucleotide
  misc_feature (34)..(36): n is a, c, g, or t
tgcaggaccagagaattcgaatacatcaattgannngatcgacatg

SEQ ID NO: 5211 - DNA, 46 bp, Artificial Sequence
  Synthesized adaptor oligonucleotide
  misc_feature (34)..(36): n is a, c, g, or t
tgcaggaccagagaattcgaatacaagcaatggnnngatcgacatg

SEQ ID NO: 5212 - DNA, 46 bp, Artificial Sequence
  Synthesized adaptor oligonucleotide
  misc_feature (34)..(36): n is a, c, g, or t
tgcaggaccagagaattcgaatacagtagtgagnnngatcgacatg

SEQ ID NO: 5213 - DNA, 46 bp, Artificial Sequence
  Synthesized adaptor oligonucleotide
  misc_feature (34)..(36): n is a, c, g, or t
tgcaggaccagagaattcgaatacacactgcggnnngatcgacatg

SEQ ID NO: 5214 - DNA, 46 bp, Artificial Sequence
  Synthesized adaptor oligonucleotide
  misc_feature (34)..(36): n is a, c, g, or t
tgcaggaccagagaattcgaatacaaccgctccnnngatcgacatg

SEQ ID NO: 5215 - DNA, 46 bp, Artificial Sequence
  Synthesized adaptor oligonucleotide
  misc_feature (34)..(36): n is a, c, g, or t
tgcaggaccagagaattcgaatacactaggttgnnngatcgacatg

SEQ ID NO: 5216 - DNA, 46 bp, Artificial Sequence
  Synthesized adaptor oligonucleotide
  misc_feature (34)..(36): n is a, c, g, or t
tgcaggaccagagaattcgaatacataaaataannngatcgacatg

SEQ ID NO: 5217 - DNA, 46 bp, Artificial Sequence
  Synthesized adaptor oligonucleotide
  misc_feature (34)..(36): n is a, c, g, or t
tgcaggaccagagaattcgaatacagtcacgtannngatcgacatg

SEQ ID NO: 5218 - DNA, 46 bp, Artificial Sequence
  Synthesized adaptor oligonucleotide
  misc_feature (34)..(36): n is a, c, g, or t
tgcaggaccagagaattcgaatacaggttcgatnnngatcgacatg

SEQ ID NO: 5219 - DNA, 46 bp, Artificial Sequence
  Synthesized adaptor oligonucleotide
  misc_feature (34)..(36): n is a, c, g, or t
tgcaggaccagagaattcgaatacacaatggagnnngatcgacatg

SEQ ID NO: 5220 - DNA, 46 bp, Artificial Sequence
  Synthesized adaptor oligonucleotide
  misc_feature (34)..(36): n is a, c, g, or t
tgcaggaccagagaattcgaatacaccgagcgtnnngatcgacatg

SEQ ID NO: 5221 - DNA, 46 bp, Artificial Sequence
  Synthesized adaptor oligonucleotide
  misc_feature (34)..(36): n is a, c, g, or t
tgcaggaccagagaattcgaatacacaaacgagnnngatcgacatg

SEQ ID NO: 5222 - DNA, 46 bp, Artificial Sequence
  Synthesized adaptor oligonucleotide
  misc_feature (34)..(36): n is a, c, g, or t
tgcaggaccagagaattcgaatacagatatgttnnngatcgacatg

SEQ ID NO: 5223 - DNA, 46 bp, Artificial Sequence
  Synthesized adaptor oligonucleotide
  misc_feature (34)..(36): n is a, c, g, or t
tgcaggaccagagaattcgaatacagttctgtcnnngatcgacatg

SEQ ID NO: 5224 - DNA, 46 bp, Artificial Sequence
  Synthesized adaptor oligonucleotide
  misc_feature (34)..(36): n is a, c, g, or t
tgcaggaccagagaattcgaatacatcttttctnnngatcgacatg

SEQ ID NO: 5225 - DNA, 46 bp, Artificial Sequence
  Synthesized adaptor oligonucleotide
  misc_feature (34)..(36): n is a, c, g, or t
tgcaggaccagagaattcgaatacaaaagacatnnngatcgacatg

SEQ ID NO: 5226 - DNA, 46 bp, Artificial Sequence
  Synthesized adaptor oligonucleotide
  misc_feature (34)..(36): n is a, c, g, or t
tgcaggaccagagaattcgaatacaacccatgannngatcgacatg

SEQ ID NO: 5227 - DNA, 46 bp, Artificial Sequence
  Synthesized adaptor oligonucleotide
  misc_feature (34)..(36): n is a, c, g, or t
tgcaggaccagagaattcgaatacatcctcacannngatcgacatg

SEQ ID NO: 5228 - DNA, 46 bp, Artificial Sequence
  Synthesized adaptor oligonucleotide
  misc_feature (34)..(36): n is a, c, g, or t
tgcaggaccagagaattcgaatacattgaggtcnnngatcgacatg

SEQ ID NO: 5229 - DNA, 46 bp, Artificial Sequence
  Synthesized adaptor oligonucleotide
  misc_feature (34)..(36): n is a, c, g, or t
tgcaggaccagagaattcgaatacagcgtactannntgcatcaggt

SEQ ID NO: 5230 - DNA, 46 bp, Artificial Sequence
  Synthesized adaptor oligonucleotide
  misc_feature (34)..(36): n is a, c, g, or t
tgcaggaccagagaattcgaatacaaggttaggnnntgcatcaggt

SEQ ID NO: 5231 - DNA, 46 bp, Artificial Sequence
  Synthesized adaptor oligonucleotide
  misc_feature (34)..(36): n is a, c, g, or t
tgcaggaccagagaattcgaatacactccacatnnntgcatcaggt

SEQ ID NO: 5232 - DNA, 46 bp, Artificial Sequence
  Synthesized adaptor oligonucleotide
  misc_feature (34)..(36): n is a, c, g, or t
tgcaggaccagagaattcgaatacacgatctagnnntgcatcaggt

SEQ ID NO: 5233 - DNA, 46 bp, Artificial Sequence
  Synthesized adaptor oligonucleotide
  misc_feature (34)..(36): n is a, c, g, or t
tgcaggaccagagaattcgaatacatcgataatnnntgcatcaggt

SEQ ID NO: 5234 - DNA, 46 bp, Artificial Sequence
  Synthesized adaptor oligonucleotide
  misc_feature (34)..(36): n is a, c, g, or t
tgcaggaccagagaattcgaatacaccacgagcnnntgcatcaggt

SEQ ID NO: 5235 - DNA, 46 bp, Artificial Sequence
  Synthesized adaptor oligonucleotide
  misc_feature (34)..(36): n is a, c, g, or t
tgcaggaccagagaattcgaatacagtggaatgnnntgcatcaggt

SEQ ID NO: 5236 - DNA, 46 bp, Artificial Sequence
  Synthesized adaptor oligonucleotide
  misc_feature (34)..(36): n is a, c, g, or t
tgcaggaccagagaattcgaatacaaaaaatgcnnntgcatcaggt

SEQ ID NO: 5237 - DNA, 46 bp, Artificial Sequence
  Synthesized adaptor oligonucleotide
  misc_feature (34)..(36): n is a, c, g, or t
tgcaggaccagagaattcgaatacagactagtcnnntgcatcaggt

SEQ ID NO: 5238 - DNA, 46 bp, Artificial Sequence
  Synthesized adaptor oligonucleotide
  misc_feature (34)..(36): n is a, c, g, or t
tgcaggaccagagaattcgaatacacgtagaagnnntgcatcaggt

SEQ ID NO: 5239 - DNA, 46 bp, Artificial Sequence
  Synthesized adaptor oligonucleotide
  misc_feature (34)..(36): n is a, c, g, or t
tgcaggaccagagaattcgaatacagtgtgaagnnntgcatcaggt

SEQ ID NO: 5240 - DNA, 46 bp, Artificial Sequence
  Synthesized adaptor oligonucleotide
  misc_feature (34)..(36): n is a, c, g, or t
tgcaggaccagagaattcgaatacaaagtacttnnntgcatcaggt

SEQ ID NO: 5241 - DNA, 46 bp, Artificial Sequence
  Synthesized adaptor oligonucleotide
  misc_feature (34)..(36): n is a, c, g, or t
tgcaggaccagagaattcgaatacacgaacgttnnntgcatcaggt

SEQ ID NO: 5242 - DNA, 46 bp, Artificial Sequence
  Synthesized adaptor oligonucleotide
  misc_feature (34)..(36): n is a, c, g, or t
tgcaggaccagagaattcgaatacaattgctggnnntgcatcaggt

SEQ ID NO: 5243 - DNA, 46 bp, Artificial Sequence
  Synthesized adaptor oligonucleotide
  misc_feature (34)..(36): n is a, c, g, or t
tgcaggaccagagaattcgaatacatgtgtgtgnnntgcatcaggt

SEQ ID NO: 5244 - DNA, 46 bp, Artificial Sequence
  Synthesized adaptor oligonucleotide
  misc_feature (34)..(36): n is a, c, g, or t
tgcaggaccagagaattcgaatacaacatctttnnntgcatcaggt

SEQ ID NO: 5245 - DNA, 46 bp, Artificial Sequence
  Synthesized adaptor oligonucleotide
  misc_feature (34)..(36): n is a, c, g, or t
tgcaggaccagagaattcgaatacacgatgctannntgcatcaggt

SEQ ID NO: 5246 - DNA, 46 bp, Artificial Sequence
  Synthesized adaptor oligonucleotide
  misc_feature (34)..(36): n is a, c, g, or t
tgcaggaccagagaattcgaatacatagtccagnnntgcatcaggt

SEQ ID NO: 5247 - DNA, 46 bp, Artificial Sequence
  Synthesized adaptor oligonucleotide
  misc_feature (34)..(36): n is a, c, g, or t
tgcaggaccagagaattcgaatacacagtaattnnntgcatcaggt

SEQ ID NO: 5248 - DNA, 46 bp, Artificial Sequence
  Synthesized adaptor oligonucleotide
  misc_feature (34)..(36): n is a, c, g, or t
tgcaggaccagagaattcgaatacaaaggtggtnnntgcatcaggt

SEQ ID NO: 5249 - DNA, 46 bp, Artificial Sequence
  Synthesized adaptor oligonucleotide
  misc_feature (34)..(36): n is a, c, g, or t
tgcaggaccagagaattcgaatacacggtggtcnnntgcatcaggt

SEQ ID NO: 5250 - DNA, 46 bp, Artificial Sequence
  Synthesized adaptor oligonucleotide
  misc_feature (34)..(36): n is a, c, g, or t
tgcaggaccagagaattcgaatacagtggttgtnnntgcatcaggt

SEQ ID NO: 5251 - DNA, 46 bp, Artificial Sequence
  Synthesized adaptor oligonucleotide
  misc_feature (34)..(36): n is a, c, g, or t
tgcaggaccagagaattcgaatacatgtattctnnntgcatcaggt

SEQ ID NO: 5252 - DNA, 46 bp, Artificial Sequence
  Synthesized adaptor oligonucleotide
  misc_feature (34)..(36): n is a, c, g, or t
tgcaggaccagagaattcgaatacataagtcgcnnntgcatcaggt

SEQ ID NO: 5253 - DNA, 46 bp, Artificial Sequence
  Synthesized adaptor oligonucleotide
  misc_feature (34)..(36): n is a, c, g, or t
tgcaggaccagagaattcgaatacataggagcannntgcatcaggt

SEQ ID NO: 5254 - DNA, 46 bp, Artificial Sequence
  Synthesized adaptor oligonucleotide
  misc_feature (34)..(36): n is a, c, g, or t
tgcaggaccagagaattcgaatacacataaatcnnntgcatcaggt

SEQ ID NO: 5255 - DNA, 46 bp, Artificial Sequence
  Synthesized adaptor oligonucleotide
  misc_feature (34)..(36): n is a, c, g, or t
tgcaggaccagagaattcgaatacaagctgtacnnntgcatcaggt

SEQ ID NO: 5256 - DNA, 46 bp, Artificial Sequence
  Synthesized adaptor oligonucleotide
  misc_feature (34)..(36): n is a, c, g, or t
tgcaggaccagagaattcgaatacattgcgcttnnntgcatcaggt

SEQ ID NO: 5257 - DNA, 46 bp, Artificial Sequence
  Synthesized adaptor oligonucleotide
  misc_feature (34)..(36): n is a, c, g, or t
tgcaggaccagagaattcgaatacaaggcgtggnnntgcatcaggt

SEQ ID NO: 5258 - DNA, 46 bp, Artificial Sequence
  Synthesized adaptor oligonucleotide
  misc_feature (34)..(36): n is a, c, g, or t
tgcaggaccagagaattcgaatacagtctaggtnnntgcatcaggt

SEQ ID NO: 5259 - DNA, 46 bp, Artificial Sequence
  Synthesized adaptor oligonucleotide
  misc_feature (34)..(36): n is a, c, g, or t
tgcaggaccagagaattcgaatacatccgtaagnnntgcatcaggt

SEQ ID NO: 5260 - DNA, 46 bp, Artificial Sequence
  Synthesized adaptor oligonucleotide
  misc_feature (34)..(36): n is a, c, g, or t
tgcaggaccagagaattcgaatacatatcggcannntgcatcaggt

SEQ ID NO: 5261 - DNA, 46 bp, Artificial Sequence
  Synthesized adaptor oligonucleotide
  misc_feature (34)..(36): n is a, c, g, or t
tgcaggaccagagaattcgaatacaatcatcggnnntgcatcaggt

SEQ ID NO: 5262 - DNA, 46 bp, Artificial Sequence
  Synthesized adaptor oligonucleotide
  misc_feature (34)..(36): n is a, c, g, or t
tgcaggaccagagaattcgaatacaacgtctgannntgcatcaggt

SEQ ID NO: 5263 - DNA, 46 bp, Artificial Sequence
  Synthesized adaptor oligonucleotide
  misc_feature (34)..(36): n is a, c, g, or t
tgcaggaccagagaattcgaatacaacggtactnnntgcatcaggt

SEQ ID NO: 5264 - DNA, 46 bp, Artificial Sequence
  Synthesized adaptor oligonucleotide
  misc_feature (34)..(36): n is a, c, g, or t
tgcaggaccagagaattcgaatacatgcaaggannntgcatcaggt

SEQ ID NO: 5265 - DNA, 46 bp, Artificial Sequence
  Synthesized adaptor oligonucleotide
  misc_feature (34)..(36): n is a, c, g, or t
tgcaggaccagagaattcgaatacaagactcacnnntgcatcaggt

SEQ ID NO: 5266 - DNA, 46 bp, Artificial Sequence
  Synthesized adaptor oligonucleotide
  misc_feature (34)..(36): n is a, c, g, or t
tgcaggaccagagaattcgaatacacaatcagcnnntgcatcaggt

SEQ ID NO: 5267 - DNA, 46 bp, Artificial Sequence
  Synthesized adaptor oligonucleotide
  misc_feature (34)..(36): n is a, c, g, or t
tgcaggaccagagaattcgaatacatggctgtannntgcatcaggt

SEQ ID NO: 5268 - DNA, 46 bp, Artificial Sequence
  Synthesized adaptor oligonucleotide
  misc_feature (34)..(36): n is a, c, g, or t
tgcaggaccagagaattcgaatacagtttacccnnntgcatcaggt

SEQ ID NO: 5269 - DNA, 46 bp, Artificial Sequence
  Synthesized adaptor oligonucleotide
  misc_feature (34)..(36): n is a, c, g, or t
tgcaggaccagagaattcgaatacacgtcagtannntgcatcaggt

SEQ ID NO: 5270 - DNA, 46 bp, Artificial Sequence
  Synthesized adaptor oligonucleotide
  misc_feature (34)..(36): n is a, c, g, or t
tgcaggaccagagaattcgaatacacgacggagnnntgcatcaggt

SEQ ID NO: 5271 - DNA, 46 bp, Artificial Sequence
  Synthesized adaptor oligonucleotide
  misc_feature (34)..(36): n is a, c, g, or t
tgcaggaccagagaattcgaatacaatatgcgcnnntgcatcaggt

SEQ ID NO: 5272 - DNA, 46 bp, Artificial Sequence
  Synthesized adaptor oligonucleotide
  misc_feature (34)..(36): n is a, c, g, or t
tgcaggaccagagaattcgaatacagctggccannntgcatcaggt

SEQ ID NO: 5273 - DNA, 46 bp, Artificial Sequence
  Synthesized adaptor oligonucleotide
  misc_feature (34)..(36): n is a, c, g, or t
tgcaggaccagagaattcgaatacacgcgtctcnnntgcatcaggt

SEQ ID NO: 5274 - DNA, 46 bp, Artificial Sequence
  Synthesized adaptor oligonucleotide
  misc_feature (34)..(36): n is a, c, g, or t
tgcaggaccagagaattcgaatacaataagtgannntgcatcaggt

SEQ ID NO: 5275 - DNA, 46 bp, Artificial Sequence
  Synthesized adaptor oligonucleotide
  misc_feature (34)..(36): n is a, c, g, or t
tgcaggaccagagaattcgaatacagacagtctnnntgcatcaggt

SEQ ID NO: 5276 - DNA, 46 bp, Artificial Sequence
  Synthesized adaptor oligonucleotide
  misc_feature (34)..(36): n is a, c, g, or t
tgcaggaccagagaattcgaatacagcaaggtannntgcatcaggt

SEQ ID NO: 5277 - DNA, 46 bp, Artificial Sequence
  Synthesized adaptor oligonucleotide
  misc_feature (34)..(36): n is a, c, g, or t
tgcaggaccagagaattcgaatacacacgaactnnntgcatcaggt

SEQ ID NO: 5278 - DNA, 46 bp, Artificial Sequence
  Synthesized adaptor oligonucleotide
  misc_feature (34)..(36): n is a, c, g, or t
tgcaggaccagagaattcgaatacatacactggnnntgcatcaggt

SEQ ID NO: 5279 - DNA, 46 bp, Artificial Sequence
  Synthesized adaptor oligonucleotide
  misc_feature (34)..(36): n is a, c, g, or t
tgcaggaccagagaattcgaatacaatttcgttnnntgcatcaggt

SEQ ID NO: 5280 - DNA, 46 bp, Artificial Sequence
  Synthesized adaptor oligonucleotide
  misc_feature (34)..(36): n is a, c, g, or t
tgcaggaccagagaattcgaatacatctgcgccnnntgcatcaggt

SEQ ID NO: 5281 - DNA, 46 bp, Artificial Sequence
  Synthesized adaptor oligonucleotide
  misc_feature (34)..(36): n is a, c, g, or t
tgcaggaccagagaattcgaatacacgagctatnnntgcatcaggt

SEQ ID NO: 5282 - DNA, 46 bp, Artificial Sequence
  Synthesized adaptor oligonucleotide
  misc_feature (34)..(36): n is a, c, g, or t
tgcaggaccagagaattcgaatacaacgccatannntgcatcaggt

SEQ ID NO: 5283 - DNA, 46 bp, Artificial Sequence
  Synthesized adaptor oligonucleotide
  misc_feature (34)..(36): n is a, c, g, or t
tgcaggaccagagaattcgaatacatcctctgannntgcatcaggt

SEQ ID NO: 5284 - DNA, 46 bp, Artificial Sequence
  Synthesized adaptor oligonucleotide
  misc_feature (34)..(36): n is a, c, g, or t
tgcaggaccagagaattcgaatacaaattctagnnntgcatcaggt

SEQ ID NO: 5285 - DNA, 46 bp, Artificial Sequence
  Synthesized adaptor oligonucleotide
  misc_feature (34)..(36): n is a, c, g, or t
tgcaggaccagagaattcgaatacacctcagccnnntgcatcaggt

SEQ ID NO: 5286 - DNA, 46 bp, Artificial Sequence
  Synthesized adaptor oligonucleotide
  misc_feature (34)..(36): n is a, c, g, or t
tgcaggaccagagaattcgaatacaaccccggannntgcatcaggt

SEQ ID NO: 5287 - DNA, 46 bp, Artificial Sequence
  Synthesized adaptor oligonucleotide
  misc_feature (34)..(36): n is a, c, g, or t
tgcaggaccagagaattcgaatacagtgataggnnntgcatcaggt

SEQ ID NO: 5288 - DNA, 46 bp, Artificial Sequence
  Synthesized adaptor oligonucleotide
  misc_feature (34)..(36): n is a, c, g, or t
tgcaggaccagagaattcgaatacattgaattgnnntgcatcaggt

SEQ ID NO: 5289 - DNA, 46 bp, Artificial Sequence
  Synthesized adaptor oligonucleotide
  misc_feature (34)..(36): n is a, c, g, or t
tgcaggaccagagaattcgaatacataactaacnnnacgtatgcca

SEQ ID NO: 5290 - DNA, 46 bp, Artificial Sequence
  Synthesized adaptor oligonucleotide
  misc_feature (34)..(36): n is a, c, g, or t
tgcaggaccagagaattcgaatacaaaactcgcnnnacgtatgcca

SEQ ID NO: 5291 - DNA, 46 bp, Artificial Sequence
  Synthesized adaptor oligonucleotide
  misc_feature (34)..(36): n is a, c, g, or t
tgcaggaccagagaattcgaatacatgagttgcnnnacgtatgcca

SEQ ID NO: 5292 - DNA, 46 bp, Artificial Sequence
  Synthesized adaptor oligonucleotide
  misc_feature (34)..(36): n is a, c, g, or t
tgcaggaccagagaattcgaatacaacaacaaannnacgtatgcca

SEQ ID NO: 5293 - DNA, 46 bp, Artificial Sequence
  Synthesized adaptor oligonucleotide
  misc_feature (34)..(36): n is a, c, g, or t
tgcaggaccagagaattcgaatacagccctaccnnnacgtatgcca

SEQ ID NO: 5294 - DNA, 46 bp, Artificial Sequence
  Synthesized adaptor oligonucleotide
  misc_feature (34)..(36): n is a, c, g, or t
tgcaggaccagagaattcgaatacagttgagagnnnacgtatgcca

SEQ ID NO: 5295 - DNA, 46 bp, Artificial Sequence
  Synthesized adaptor oligonucleotide
  misc_feature (34)..(36): n is a, c, g, or t
tgcaggaccagagaattcgaatacacagtgactnnnacgtatgcca

SEQ ID NO: 5296 - DNA, 46 bp, Artificial Sequence
  Synthesized adaptor oligonucleotide
  misc_feature (34)..(36): n is a, c, g, or t
tgcaggaccagagaattcgaatacatgaagacgnnnacgtatgcca

SEQ ID NO: 5297 - DNA, 46 bp, Artificial Sequence
  Synthesized adaptor oligonucleotide
  misc_feature (34)..(36): n is a, c, g, or t
tgcaggaccagagaattcgaatacaccctatgtnnnacgtatgcca

SEQ ID NO: 5298 - DNA, 46 bp, Artificial Sequence
  Synthesized adaptor oligonucleotide
  misc_feature (34)..(36): n is a, c, g, or t
tgcaggaccagagaattcgaatacatggtttggnnnacgtatgcca

SEQ ID NO: 5299 - DNA, 46 bp, Artificial Sequence
  Synthesized adaptor oligonucleotide
  misc_feature (34)..(36): n is a, c, g, or t
tgcaggaccagagaattcgaatacagcactcggnnnacgtatgcca

SEQ ID NO: 5300 - DNA, 46 bp, Artificial Sequence
  Synthesized adaptor oligonucleotide
  misc_feature (34)..(36): n is a, c, g, or t
tgcaggaccagagaattcgaatacaaaagagttnnnacgtatgcca

SEQ ID NO: 5301 - DNA, 46 bp, Artificial Sequence
  Synthesized adaptor oligonucleotide
  misc_feature (34)..(36): n is a, c, g, or t
tgcaggaccagagaattcgaatacagttcgtgannnacgtatgcca

SEQ ID NO: 5302 - DNA, 46 bp, Artificial Sequence
  Synthesized adaptor oligonucleotide
  misc_feature (34)..(36): n is a, c, g, or t
tgcaggaccagagaattcgaatacatccccacgnnnacgtatgcca

SEQ ID NO: 5303 - DNA, 46 bp, Artificial Sequence
  Synthesized adaptor oligonucleotide
  misc_feature (34)..(36): n is a, c, g, or t
tgcaggaccagagaattcgaatacaaaattctgnnnacgtatgcca

SEQ ID NO: 5304 - DNA, 46 bp, Artificial Sequence
  Synthesized adaptor oligonucleotide
  misc_feature (34)..(36): n is a, c, g, or t
tgcaggaccagagaattcgaatacatccacagannnacgtatgcca

SEQ ID NO: 5305 - DNA, 46 bp, Artificial Sequence
  Synthesized adaptor oligonucleotide
  misc_feature (34)..(36): n is a, c, g, or t
tgcaggaccagagaattcgaatacaagagttttnnnacgtatgcca

SEQ ID NO: 5306 - DNA, 46 bp, Artificial Sequence
  Synthesized adaptor oligonucleotide
  misc_feature (34)..(36): n is a, c, g, or t
tgcaggaccagagaattcgaatacatggagcggnnnacgtatgcca

SEQ ID NO: 5307 - DNA, 46 bp, Artificial Sequence
  Synthesized adaptor oligonucleotide
  misc_feature (34)..(36): n is a, c, g, or t
tgcaggaccagagaattcgaatacactttaatcnnnacgtatgcca

SEQ ID NO: 5308 - DNA, 46 bp, Artificial Sequence
  Synthesized adaptor oligonucleotide
  misc_feature (34)..(36): n is a, c, g, or t
tgcaggaccagagaattcgaatacaacgtcagtnnnacgtatgcca

SEQ ID NO: 5309 - DNA, 46 bp, Artificial Sequence
  Synthesized adaptor oligonucleotide
  misc_feature (34)..(36): n is a, c, g, or t
tgcaggaccagagaattcgaatacatggagcttnnnacgtatgcca

SEQ ID NO: 5310 - DNA, 46 bp, Artificial Sequence
  Synthesized adaptor oligonucleotide
  misc_feature (34)..(36): n is a, c, g, or t
tgcaggaccagagaattcgaatacagcacaccgnnnacgtatgcca

SEQ ID NO: 5311 - DNA, 46 bp, Artificial Sequence
  Synthesized adaptor oligonucleotide
  misc_feature (34)..(36): n is a, c, g, or t
tgcaggaccagagaattcgaatacatttgctgcnnnacgtatgcca

SEQ ID NO: 5312 - DNA, 46 bp, Artificial Sequence
  Synthesized adaptor oligonucleotide
  misc_feature (34)..(36): n is a, c, g, or t
tgcaggaccagagaattcgaatacacagcgaaannnacgtatgcca

SEQ ID NO: 5313 - DNA, 46 bp, Artificial Sequence
  Synthesized adaptor oligonucleotide
  misc_feature (34)..(36): n is a, c, g, or t
tgcaggaccagagaattcgaatacaacgattgcnnnacgtatgcca

SEQ ID NO: 5314 - DNA, 46 bp, Artificial Sequence
  Synthesized adaptor oligonucleotide
  misc_feature (34)..(36): n is a, c, g, or t
tgcaggaccagagaattcgaatacatagcgttgnnnacgtatgcca

SEQ ID NO: 5315 - DNA, 46 bp, Artificial Sequence
  Synthesized adaptor oligonucleotide
  misc_feature (34)..(36): n is a, c, g, or t
tgcaggaccagagaattcgaatacaacgctgcgnnnacgtatgcca

SEQ ID NO: 5316 - DNA, 46 bp, Artificial Sequence
  Synthesized adaptor oligonucleotide
  misc_feature (34)..(36): n is a, c, g, or t
tgcaggaccagagaattcgaatacactttattgnnnacgtatgcca

SEQ ID NO: 5317 - DNA, 46 bp, Artificial Sequence
  Synthesized adaptor oligonucleotide
  misc_feature (34)..(36): n is a, c, g, or t
tgcaggaccagagaattcgaatacagcgaaatgnnnacgtatgcca

SEQ ID NO: 5318 - DNA, 46 bp, Artificial Sequence
  Synthesized adaptor oligonucleotide
  misc_feature (34)..(36): n is a, c, g, or t
tgcaggaccagagaattcgaatacatttattgcnnnacgtatgcca

SEQ ID NO: 5319 - DNA, 46 bp, Artificial Sequence
  Synthesized adaptor oligonucleotide
  misc_feature (34)..(36): n is a, c, g, or t
tgcaggaccagagaattcgaatacatccagcggnnnacgtatgcca

SEQ ID NO: 5320 - DNA, 46 bp, Artificial Sequence
  Synthesized adaptor oligonucleotide
  misc_feature (34)..(36): n is a, c, g, or t
tgcaggaccagagaattcgaatacacgcatgcgnnnacgtatgcca

SEQ ID NO: 5321 - DNA, 46 bp, Artificial Sequence
  Synthesized adaptor oligonucleotide
  misc_feature (34)..(36): n is a, c, g, or t
tgcaggaccagagaattcgaatacaatgctggtnnnacgtatgcca

SEQ ID NO: 5322 - DNA, 46 bp, Artificial Sequence
  Synthesized adaptor oligonucleotide
  misc_feature (34)..(36): n is a, c, g, or t
tgcaggaccagagaattcgaatacaaatggcctnnnacgtatgcca

SEQ ID NO: 5323 - DNA, 46 bp, Artificial Sequence
  Synthesized adaptor oligonucleotide
  misc_feature (34)..(36): n is a, c, g, or t
tgcaggaccagagaattcgaatacaggtttagcnnnacgtatgcca

SEQ ID NO: 5324 - DNA, 46 bp, Artificial Sequence
  Synthesized adaptor oligonucleotide
  misc_feature (34)..(36): n is a, c, g, or t
tgcaggaccagagaattcgaatacattcccagtnnnacgtatgcca

SEQ ID NO: 5325 - DNA, 46 bp, Artificial Sequence
  Synthesized adaptor oligonucleotide
  misc_feature (34)..(36): n is a, c, g, or t
tgcaggaccagagaattcgaatacaagcgatgannnacgtatgcca

SEQ ID NO: 5326 - DNA, 46 bp, Artificial Sequence
  Synthesized adaptor oligonucleotide
  misc_feature (34)..(36): n is a, c, g, or t
tgcaggaccagagaattcgaatacaccggtcagnnnacgtatgcca

SEQ ID NO: 5327 - DNA, 46 bp, Artificial Sequence
  Synthesized adaptor oligonucleotide
  misc_feature (34)..(36): n is a, c, g, or t
tgcaggaccagagaattcgaatacaagtatactnnnacgtatgcca

SEQ ID NO: 5328 - DNA, 46 bp, Artificial Sequence
  Synthesized adaptor oligonucleotide
  misc_feature (34)..(36): n is a, c, g, or t
tgcaggaccagagaattcgaatacagactgagannnacgtatgcca

SEQ ID NO: 5329 - DNA, 46 bp, Artificial Sequence
  Synthesized adaptor oligonucleotide
  misc_feature (34)..(36): n is a, c, g, or t
tgcaggaccagagaattcgaatacatcacgttcnnnacgtatgcca

SEQ ID NO: 5330 - DNA, 46 bp, Artificial Sequence
  Synthesized adaptor oligonucleotide
  misc_feature (34)..(36): n is a, c, g, or t
tgcaggaccagagaattcgaatacactcactacnnnacgtatgcca

SEQ ID NO: 5331 - DNA, 46 bp, Artificial Sequence
  Synthesized adaptor oligonucleotide
  misc_feature (34)..(36): n is a, c, g, or t
tgcaggaccagagaattcgaatacagaagagagnnnacgtatgcca

SEQ ID NO: 5332 - DNA, 46 bp, Artificial Sequence
  Synthesized adaptor oligonucleotide
  misc_feature (34)..(36): n is a, c, g, or t
tgcaggaccagagaattcgaatacaccctgcacnnnacgtatgcca

SEQ ID NO: 5333 - DNA, 46 bp, Artificial Sequence
  Synthesized adaptor oligonucleotide
  misc_feature (34)..(36): n is a, c, g, or t
tgcaggaccagagaattcgaatacagcaacgaannnacgtatgcca

SEQ ID NO: 5334 - DNA, 46 bp, Artificial Sequence
  Synthesized adaptor oligonucleotide
  misc_feature (34)..(36): n is a, c, g, or t
tgcaggaccagagaattcgaatacagctaccttnnnacgtatgcca

SEQ ID NO: 5335 - DNA, 46 bp, Artificial Sequence
  Synthesized adaptor oligonucleotide
  misc_feature (34)..(36): n is a, c, g, or t
tgcaggaccagagaattcgaatacaacaccttcnnnacgtatgcca

SEQ ID NO: 5336 - DNA, 46 bp, Artificial Sequence
  Synthesized adaptor oligonucleotide
  misc_feature (34)..(36): n is a, c, g, or t
tgcaggaccagagaattcgaatacactgttaaannnacgtatgcca

SEQ ID NO: 5337 - DNA, 46 bp, Artificial Sequence
  Synthesized adaptor oligonucleotide
  misc_feature (34)..(36): n is a, c, g, or t
tgcaggaccagagaattcgaatacaatctcggannnacgtatgcca

SEQ ID NO: 5338 - DNA, 46 bp, Artificial Sequence
  Synthesized adaptor oligonucleotide
  misc_feature (34)..(36): n is a, c, g, or t
tgcaggaccagagaattcgaatacaatgttgcgnnnacgtatgcca

SEQ ID NO: 5339 - DNA, 46 bp, Artificial Sequence
  Synthesized adaptor oligonucleotide
  misc_feature (34)..(36): n is a, c, g, or t
tgcaggaccagagaattcgaatacagcacatgtnnnacgtatgcca

SEQ ID NO: 5340 - DNA, 46 bp, Artificial Sequence
  Synthesized adaptor oligonucleotide
  misc_feature (34)..(36): n is a, c, g, or t
tgcaggaccagagaattcgaatacaaatccggtnnnacgtatgcca

SEQ ID NO: 5341 - DNA, 46 bp, Artificial Sequence
  Synthesized adaptor oligonucleotide
  misc_feature (34)..(36): n is a, c, g, or t
tgcaggaccagagaattcgaatacactatttacnnnacgtatgcca

SEQ ID NO: 5342 - DNA, 46 bp, Artificial Sequence
  Synthesized adaptor oligonucleotide
  misc_feature (34)..(36): n is a, c, g, or t
tgcaggaccagagaattcgaatacacgtgccagnnnacgtatgcca

SEQ ID NO: 5343 - DNA, 46 bp, Artificial Sequence
  Synthesized adaptor oligonucleotide
  misc_feature (34)..(36): n is a, c, g, or t
tgcaggaccagagaattcgaatacaccggtagcnnnacgtatgcca

SEQ ID NO: 5344 - DNA, 46 bp, Artificial Sequence
  Synthesized adaptor oligonucleotide
  misc_feature (34)..(36): n is a, c, g, or t
tgcaggaccagagaattcgaatacaacatatgtnnnacgtatgcca

SEQ ID NO: 5345 - DNA, 46 bp, Artificial Sequence
  Synthesized adaptor oligonucleotide
  misc_feature (34)..(36): n is a, c, g, or t
tgcaggaccagagaattcgaatacatggtggccnnnacgtatgcca

SEQ ID NO: 5346 - DNA, 46 bp, Artificial Sequence
  Synthesized adaptor oligonucleotide
  misc_feature (34)..(36): n is a, c, g, or t
tgcaggaccagagaattcgaatacacaactcagnnnacgtatgcca

SEQ ID NO: 5347 - DNA, 46 bp, Artificial Sequence
  Synthesized adaptor oligonucleotide
  misc_feature (34)..(36): n is a, c, g, or t
tgcaggaccagagaattcgaatacaccaattttnnnacgtatgcca

SEQ ID NO: 5348 - DNA, 46 bp, Artificial Sequence
  Synthesized adaptor oligonucleotide
  misc_feature (34)..(36): n is a, c, g, or t
tgcaggaccagagaattcgaatacaaactgaggnnnacgtatgcca

SEQ ID NO: 5349 - DNA, 46 bp, Artificial Sequence
  Synthesized adaptor oligonucleotide
  misc_feature (34)..(36): n is a, c, g, or t
tgcaggaccagagaattcgaatacaacgtagtcnnnctagcgttac

SEQ ID NO: 5350 - DNA, 46 bp, Artificial Sequence
  Synthesized adaptor oligonucleotide
  misc_feature (34)..(36): n is a, c, g, or t
tgcaggaccagagaattcgaatacagcatggccnnnctagcgttac

SEQ ID NO: 5351 - DNA, 46 bp, Artificial Sequence
  Synthesized adaptor oligonucleotide
  misc_feature (34)..(36): n is a, c, g, or t
tgcaggaccagagaattcgaatacaagtcagagnnnctagcgttac

SEQ ID NO: 5352 - DNA, 46 bp, Artificial Sequence
  Synthesized adaptor oligonucleotide
  misc_feature (34)..(36): n is a, c, g, or t
tgcaggaccagagaattcgaatacatgaatactnnnctagcgttac

SEQ ID NO: 5353 - DNA, 46 bp, Artificial Sequence
  Synthesized adaptor oligonucleotide
  misc_feature (34)..(36): n is a, c, g, or t
tgcaggaccagagaattcgaatacagtatgaggnnnctagcgttac

SEQ ID NO: 5354 - DNA, 46 bp, Artificial Sequence
  Synthesized adaptor oligonucleotide
  misc_feature (34)..(36): n is a, c, g, or t
tgcaggaccagagaattcgaatacagacttgtgnnnctagcgttac

SEQ ID NO: 5355 - DNA, 46 bp, Artificial Sequence
  Synthesized adaptor oligonucleotide
  misc_feature (34)..(36): n is a, c, g, or t
tgcaggaccagagaattcgaatacaaattaaggnnnctagcgttac

SEQ ID NO: 5356 - DNA, 46 bp, Artificial Sequence
  Synthesized adaptor oligonucleotide
  misc_feature (34)..(36): n is a, c, g, or t
tgcaggaccagagaattcgaatacacggttgtannnctagcgttac

SEQ ID NO: 5357 - DNA, 46 bp, Artificial Sequence
  Synthesized adaptor oligonucleotide
  misc_feature (34)..(36): n is a, c, g, or t
tgcaggaccagagaattcgaatacacctgtccgnnnctagcgttac

SEQ ID NO: 5358 - DNA, 46 bp, Artificial Sequence
  Synthesized adaptor oligonucleotide
  misc_feature (34)..(36): n is a, c, g, or t
tgcaggaccagagaattcgaatacagtgacgccnnnctagcgttac

SEQ ID NO: 5359 - DNA, 46 bp, Artificial Sequence
  Synthesized adaptor oligonucleotide
  misc_feature (34)..(36): n is a, c, g, or t
tgcaggaccagagaattcgaatacagtgttgcannnctagcgttac

SEQ ID NO: 5360 - DNA, 46 bp, Artificial Sequence
  Synthesized adaptor oligonucleotide
  misc_feature (34)..(36): n is a, c, g, or t
tgcaggaccagagaattcgaatacacccgatttnnnctagcgttac

SEQ ID NO: 5361 - DNA, 46 bp, Artificial Sequence
  Synthesized adaptor oligonucleotide
  misc_feature (34)..(36): n is a, c, g, or t
tgcaggaccagagaattcgaatacatttccgtgnnnctagcgttac

SEQ ID NO: 5362 - DNA, 46 bp, Artificial Sequence
  Synthesized adaptor oligonucleotide
  misc_feature (34)..(36): n is a, c, g, or t
tgcaggaccagagaattcgaatacaaaggtcctnnnctagcgttac

SEQ ID NO: 5363 - DNA, 46 bp, Artificial Sequence
  Synthesized adaptor oligonucleotide
  misc_feature (34)..(36): n is a, c, g, or t
tgcaggaccagagaattcgaatacagagccaaannnctagcgttac

SEQ ID NO: 5364 - DNA, 46 bp, Artificial Sequence
  Synthesized adaptor oligonucleotide
  misc_feature (34)..(36): n is a, c, g, or t
tgcaggaccagagaattcgaatacacccttcaannnctagcgttac

SEQ ID NO: 5365 - DNA, 46 bp, Artificial Sequence
  Synthesized adaptor oligonucleotide
  misc_feature (34)..(36): n is a, c, g, or t
tgcaggaccagagaattcgaatacagcgcggttnnnctagcgttac

SEQ ID NO: 5366 - DNA, 46 bp, Artificial Sequence
  Synthesized adaptor oligonucleotide
  misc_feature (34)..(36): n is a, c, g, or t
tgcaggaccagagaattcgaatacacttctagcnnnctagcgttac

SEQ ID NO: 5367 - DNA, 46 bp, Artificial Sequence
  Synthesized adaptor oligonucleotide
  misc_feature (34)..(36): n is a, c, g, or t
tgcaggaccagagaattcgaatacagtgtaaaannnctagcgttac

SEQ ID NO: 5368 - DNA, 46 bp, Artificial Sequence
  Synthesized adaptor oligonucleotide
  misc_feature (34)..(36): n is a, c, g, or t
tgcaggaccagagaattcgaatacaactatgcgnnnctagcgttac

SEQ ID NO: 5369 - DNA, 46 bp, Artificial Sequence
  Synthesized adaptor oligonucleotide
  misc_feature (34)..(36): n is a, c, g, or t
tgcaggaccagagaattcgaatacacgccagacnnnctagcgttac

SEQ ID NO: 5370 - DNA, 46 bp, Artificial Sequence
  Synthesized adaptor oligonucleotide
  misc_feature (34)..(36): n is a, c, g, or t
tgcaggaccagagaattcgaatacaatcagtgcnnnctagcgttac

SEQ ID NO: 5371 - DNA, 46 bp, Artificial Sequence
  Synthesized adaptor oligonucleotide
  misc_feature (34)..(36): n is a, c, g, or t
tgcaggaccagagaattcgaatacagttctaccnnnctagcgttac

SEQ ID NO: 5372 - DNA, 46 bp, Artificial Sequence
  Synthesized adaptor oligonucleotide
  misc_feature (34)..(36): n is a, c, g, or t
tgcaggaccagagaattcgaatacacaccatagnnnctagcgttac

SEQ ID NO: 5373 - DNA, 46 bp, Artificial Sequence
  Synthesized adaptor oligonucleotide
  misc_feature (34)..(36): n is a, c, g, or t
tgcaggaccagagaattcgaatacacaaagatannnctagcgttac

SEQ ID NO: 5374 - DNA, 46 bp, Artificial Sequence
  Synthesized adaptor oligonucleotide
  misc_feature (34)..(36): n is a, c, g, or t
tgcaggaccagagaattcgaatacacaaggcttnnnctagcgttac

SEQ ID NO: 5375 - DNA, 46 bp, Artificial Sequence
  Synthesized adaptor oligonucleotide
  misc_feature (34)..(36): n is a, c, g, or t
tgcaggaccagagaattcgaatacagtcgttagnnnctagcgttac

SEQ ID NO: 5376 - DNA, 46 bp, Artificial Sequence
  Synthesized adaptor oligonucleotide
  misc_feature (34)..(36): n is a, c, g, or t
tgcaggaccagagaattcgaatacaaacgttcgnnnctagcgttac

SEQ ID NO: 5377 - DNA, 46 bp, Artificial Sequence
  Synthesized adaptor oligonucleotide
  misc_feature (34)..(36): n is a, c, g, or t
tgcaggaccagagaattcgaatacaatggctgtnnnctagcgttac

SEQ ID NO: 5378 - DNA, 46 bp, Artificial Sequence
  Synthesized adaptor oligonucleotide
  misc_feature (34)..(36): n is a, c, g, or t
tgcaggaccagagaattcgaatacaattctatcnnnctagcgttac

SEQ ID NO: 5379 - DNA, 46 bp, Artificial Sequence
  Synthesized adaptor oligonucleotide
  misc_feature (34)..(36): n is a, c, g, or t
tgcaggaccagagaattcgaatacaggtagcaannnctagcgttac

SEQ ID NO: 5380 - DNA, 46 bp, Artificial Sequence
  Synthesized adaptor oligonucleotide
  misc_feature (34)..(36): n is a, c, g, or t
tgcaggaccagagaattcgaatacatggtgactnnnctagcgttac

SEQ ID NO: 5381 - DNA, 46 bp, Artificial Sequence
  Synthesized adaptor oligonucleotide
  misc_feature (34)..(36): n is a, c, g, or t
tgcaggaccagagaattcgaatacatcctaattnnnctagcgttac

SEQ ID NO: 5382 - DNA, 46 bp, Artificial Sequence
  Synthesized adaptor oligonucleotide
  misc_feature (34)..(36): n is a, c, g, or t
tgcaggaccagagaattcgaatacagcccggcgnnnctagcgttac

SEQ ID NO: 5383 - DNA, 46 bp, Artificial Sequence
  Synthesized adaptor oligonucleotide
  misc_feature (34)..(36): n is a, c, g, or t
tgcaggaccagagaattcgaatacacccgcaagnnnctagcgttac

SEQ ID NO: 5384 - DNA, 46 bp, Artificial Sequence
  Synthesized adaptor oligonucleotide
  misc_feature (34)..(36): n is a, c, g, or t
tgcaggaccagagaattcgaatacatccctggcnnnctagcgttac

SEQ ID NO: 5385 - DNA, 46 bp, Artificial Sequence
  Synthesized adaptor oligonucleotide
  misc_feature (34)..(36): n is a, c, g, or t
tgcaggaccagagaattcgaatacagatcccttnnnctagcgttac

SEQ ID NO: 5386 - DNA, 46 bp, Artificial Sequence
  Synthesized adaptor oligonucleotide
  misc_feature (34)..(36): n is a, c, g, or t
tgcaggaccagagaattcgaatacatagatgaannnctagcgttac

SEQ ID NO: 5387 - DNA, 46 bp, Artificial Sequence
  Synthesized adaptor oligonucleotide
  misc_feature (34)..(36): n is a, c, g, or t
tgcaggaccagagaattcgaatacaaggcaagtnnnctagcgttac

SEQ ID NO: 5388 - DNA, 46 bp, Artificial Sequence
  Synthesized adaptor oligonucleotide
  misc_feature (34)..(36): n is a, c, g, or t
tgcaggaccagagaattcgaatacataatctgannnctagcgttac

SEQ ID NO: 5389 - DNA, 46 bp, Artificial Sequence
  Synthesized adaptor oligonucleotide
  misc_feature (34)..(36): n is a, c, g, or t
tgcaggaccagagaattcgaatacaggccaaaannnctagcgttac

SEQ ID NO: 5390 - DNA, 46 bp, Artificial Sequence
  Synthesized adaptor oligonucleotide
  misc_feature (34)..(36): n is a, c, g, or t
tgcaggaccagagaattcgaatacaaagcgtctnnnctagcgttac

SEQ ID NO: 5391 - DNA, 46 bp, Artificial Sequence
  Synthesized adaptor oligonucleotide
  misc_feature (34)..(36): n is a, c, g, or t
tgcaggaccagagaattcgaatacacatggccgnnnctagcgttac

SEQ ID NO: 5392 - DNA, 46 bp, Artificial Sequence
  Synthesized adaptor oligonucleotide
  misc_feature (34)..(36): n is a, c, g, or t
tgcaggaccagagaattcgaatacaggaagatcnnnctagcgttac

SEQ ID NO: 5393 - DNA, 46 bp, Artificial Sequence
  Synthesized adaptor oligonucleotide
  misc_feature (34)..(36): n is a, c, g, or t
tgcaggaccagagaattcgaatacatcagctagnnnctagcgttac

SEQ ID NO: 5394 - DNA, 46 bp, Artificial Sequence
  Synthesized adaptor oligonucleotide
  misc_feature (34)..(36): n is a, c, g, or t
tgcaggaccagagaattcgaatacactgctaagnnnctagcgttac

SEQ ID NO: 5395 - DNA, 46 bp, Artificial Sequence
  Synthesized adaptor oligonucleotide
  misc_feature (34)..(36): n is a, c, g, or t
tgcaggaccagagaattcgaatacacacttggannnctagcgttac

SEQ ID NO: 5396 - DNA, 46 bp, Artificial Sequence
  Synthesized adaptor oligonucleotide
  misc_feature (34)..(36): n is a, c, g, or t
tgcaggaccagagaattcgaatacactcgaatgnnnctagcgttac

SEQ ID NO: 5397 - DNA, 46 bp, Artificial Sequence
  Synthesized adaptor oligonucleotide
  misc_feature (34)..(36): n is a, c, g, or t
tgcaggaccagagaattcgaatacacgcttaagnnnctagcgttac

SEQ ID NO: 5398 - DNA, 46 bp, Artificial Sequence
  Synthesized adaptor oligonucleotide
  misc_feature (34)..(36): n is a, c, g, or t
tgcaggaccagagaattcgaatacaatattgtgnnnctagcgttac

SEQ ID NO: 5399 - DNA, 46 bp, Artificial Sequence
  Synthesized adaptor oligonucleotide
  misc_feature (34)..(36): n is a, c, g, or t
tgcaggaccagagaattcgaatacatttcacgcnnnctagcgttac

SEQ ID NO: 5400 - DNA, 46 bp, Artificial Sequence
  Synthesized adaptor oligonucleotide
  misc_feature (34)..(36): n is a, c, g, or t
tgcaggaccagagaattcgaatacattccatcgnnnctagcgttac

SEQ ID NO: 5401 - DNA, 46 bp, Artificial Sequence
  Synthesized adaptor oligonucleotide
  misc_feature (34)..(36): n is a, c, g, or t
tgcaggaccagagaattcgaatacaaatgacccnnnctagcgttac

SEQ ID NO: 5402 - DNA, 46 bp, Artificial Sequence
  Synthesized adaptor oligonucleotide
  misc_feature (34)..(36): n is a, c, g, or t
tgcaggaccagagaattcgaatacaatcagtcgnnnctagcgttac

SEQ ID NO: 5403 - DNA, 46 bp, Artificial Sequence
  Synthesized adaptor oligonucleotide
  misc_feature (34)..(36): n is a, c, g, or t
tgcaggaccagagaattcgaatacactctgaagnnnctagcgttac

SEQ ID NO: 5404 - DNA, 46 bp, Artificial Sequence
  Synthesized adaptor oligonucleotide
  misc_feature (34)..(36): n is a, c, g, or t
tgcaggaccagagaattcgaatacaaaagtgatnnnctagcgttac

SEQ ID NO: 5405 - DNA, 46 bp, Artificial Sequence
  Synthesized adaptor oligonucleotide
  misc_feature (34)..(36): n is a, c, g, or t
tgcaggaccagagaattcgaatacatcaacctcnnnctagcgttac

SEQ ID NO: 5406 - DNA, 46 bp, Artificial Sequence
  Synthesized adaptor oligonucleotide
  misc_feature (34)..(36): n is a, c, g, or t
tgcaggaccagagaattcgaatacagctaatgcnnnctagcgttac

SEQ ID NO: 5407 - DNA, 46 bp, Artificial Sequence
  Synthesized adaptor oligonucleotide
  misc_feature (34)..(36): n is a, c, g, or t
tgcaggaccagagaattcgaatacatattggcgnnnctagcgttac

SEQ ID NO: 5408 - DNA, 46 bp, Artificial Sequence
  Synthesized adaptor oligonucleotide
  misc_feature (34)..(36): n is a, c, g, or t
tgcaggaccagagaattcgaatacatactatctnnnctagcgttac

SEQ ID NO: 5409 - DNA, 46 bp, Artificial Sequence
  Synthesized adaptor oligonucleotide
  misc_feature (34)..(36): n is a, c, g, or t
tgcaggaccagagaattcgaatacagactcggcnnngatcgacatg

SEQ ID NO: 5410 - DNA, 46 bp, Artificial Sequence
  Synthesized adaptor oligonucleotide
  misc_feature (34)..(36): n is a, c, g, or t
tgcaggaccagagaattcgaatacagctgtatgnnngatcgacatg

SEQ ID NO: 5411 - DNA, 46 bp, Artificial Sequence
  Synthesized adaptor oligonucleotide
  misc_feature (34)..(36): n is a, c, g, or t
tgcaggaccagagaattcgaatacaaaattgctnnngatcgacatg

SEQ ID NO: 5412 - DNA, 46 bp, Artificial Sequence
  Synthesized adaptor oligonucleotide
  misc_feature (34)..(36): n is a, c, g, or t
tgcaggaccagagaattcgaatacaacatgttannngatcgacatg

SEQ ID NO: 5413 - DNA, 46 bp, Artificial Sequence
  Synthesized adaptor oligonucleotide
  misc_feature (34)..(36): n is a, c, g, or t
tgcaggaccagagaattcgaatacaagatggacnnngatcgacatg

SEQ ID NO: 5414 - DNA, 46 bp, Artificial Sequence
  Synthesized adaptor oligonucleotide
  misc_feature (34)..(36): n is a, c, g, or t
tgcaggaccagagaattcgaatacatgtctccannngatcgacatg

SEQ ID NO: 5415 - DNA, 46 bp, Artificial Sequence
  Synthesized adaptor oligonucleotide
  misc_feature (34)..(36): n is a, c, g, or t
tgcaggaccagagaattcgaatacattggctagnnngatcgacatg

SEQ ID NO: 5416 - DNA, 46 bp, Artificial Sequence
  Synthesized adaptor oligonucleotide
  misc_feature (34)..(36): n is a, c, g, or t
tgcaggaccagagaattcgaatacataatttccnnngatcgacatg

SEQ ID NO: 5417 - DNA, 46 bp, Artificial Sequence
  Synthesized adaptor oligonucleotide
  misc_feature (34)..(36): n is a, c, g, or t
tgcaggaccagagaattcgaatacagtgttaatnnngatcgacatg

SEQ ID NO: 5418 - DNA, 46 bp, Artificial Sequence
  Synthesized adaptor oligonucleotide
  misc_feature (34)..(36): n is a, c, g, or t
tgcaggaccagagaattcgaatacatgagcaagnnngatcgacatg

SEQ ID NO: 5419 - DNA, 46 bp, Artificial Sequence
  Synthesized adaptor oligonucleotide
  misc_feature (34)..(36): n is a, c, g, or t
tgcaggaccagagaattcgaatacacgcccctannngatcgacatg

SEQ ID NO: 5420 - DNA, 46 bp, Artificial Sequence
  Synthesized adaptor oligonucleotide
  misc_feature (34)..(36): n is a, c, g, or t
tgcaggaccagagaattcgaatacagtcacagtnnngatcgacatg

SEQ ID NO: 5421 - DNA, 46 bp, Artificial Sequence
  Synthesized adaptor oligonucleotide
  misc_feature (34)..(36): n is a, c, g, or t
tgcaggaccagagaattcgaatacagttggtgtnnngatcgacatg

SEQ ID NO: 5422 - DNA, 46 bp, Artificial Sequence
  Synthesized adaptor oligonucleotide
  misc_feature (34)..(36): n is a, c, g, or t
tgcaggaccagagaattcgaatacacttattacnnngatcgacatg

SEQ ID NO: 5423 - DNA, 46 bp, Artificial Sequence
  Synthesized adaptor oligonucleotide
  misc_feature (34)..(36): n is a, c, g, or t
tgcaggaccagagaattcgaatacactcgcaaannngatcgacatg

SEQ ID NO: 5424 - DNA, 46 bp, Artificial Sequence
  Synthesized adaptor oligonucleotide
  misc_feature (34)..(36): n is a, c, g, or t
tgcaggaccagagaattcgaatacactaggtgtnnngatcgacatg

SEQ ID NO: 5425 - DNA, 46 bp, Artificial Sequence
  Synthesized adaptor oligonucleotide
  misc_feature (34)..(36): n is a, c, g, or t
tgcaggaccagagaattcgaatacacaacatatnnngatcgacatg

SEQ ID NO: 5426 - DNA, 46 bp, Artificial Sequence
  Synthesized adaptor oligonucleotide
  misc_feature (34)..(36): n is a, c, g, or t
tgcaggaccagagaattcgaatacaaccgatacnnngatcgacatg

SEQ ID NO: 5427 - DNA, 46 bp, Artificial Sequence
  Synthesized adaptor oligonucleotide
  misc_feature (34)..(36): n is a, c, g, or t
tgcaggaccagagaattcgaatacaccgactggnnngatcgacatg

SEQ ID NO: 5428 - DNA, 46 bp, Artificial Sequence
  Synthesized adaptor oligonucleotide
  misc_feature (34)..(36): n is a, c, g, or t
tgcaggaccagagaattcgaatacacaacgcatnnngatcgacatg

SEQ ID NO: 5429 - DNA, 46 bp, Artificial Sequence
  Synthesized adaptor oligonucleotide
  misc_feature (34)..(36): n is a, c, g, or t
tgcaggaccagagaattcgaatacattttaattnnngatcgacatg

SEQ ID NO: 5430 - DNA, 46 bp, Artificial Sequence
  Synthesized adaptor oligonucleotide
  misc_feature (34)..(36): n is a, c, g, or t
tgcaggaccagagaattcgaatacaagtgtattnnngatcgacatg

SEQ ID NO: 5431 - DNA, 46 bp, Artificial Sequence
  Synthesized adaptor oligonucleotide
  misc_feature (34)..(36): n is a, c, g, or t
tgcaggaccagagaattcgaatacaacttcaggnnngatcgacatg

SEQ ID NO: 5432 - DNA, 46 bp, Artificial Sequence
  Synthesized adaptor oligonucleotide
  misc_feature (34)..(36): n is a, c, g, or t
tgcaggaccagagaattcgaatacaaagccgccnnngatcgacatg

SEQ ID NO: 5433 - DNA, 46 bp, Artificial Sequence
  Synthesized adaptor oligonucleotide
  misc_feature (34)..(36): n is a, c, g, or t
tgcaggaccagagaattcgaatacaccacggtgnnngatcgacatg

SEQ ID NO: 5434 - DNA, 46 bp, Artificial Sequence
  Synthesized adaptor oligonucleotide
  misc_feature (34)..(36): n is a, c, g, or t
tgcaggaccagagaattcgaatacaggctctttnnngatcgacatg

SEQ ID NO: 5435 - DNA, 46 bp, Artificial Sequence
  Synthesized adaptor oligonucleotide
  misc_feature (34)..(36): n is a, c, g, or t
tgcaggaccagagaattcgaatacacttagcctnnngatcgacatg

SEQ ID NO: 5436 - DNA, 46 bp, Artificial Sequence
  Synthesized adaptor oligonucleotide
  misc_feature (34)..(36): n is a, c, g, or t
tgcaggaccagagaattcgaatacaattagcatnnngatcgacatg

SEQ ID NO: 5437 - DNA, 46 bp, Artificial Sequence
  Synthesized adaptor oligonucleotide
  misc_feature (34)..(36): n is a, c, g, or t
tgcaggaccagagaattcgaatacagcagcttannngatcgacatg

SEQ ID NO: 5438 - DNA, 46 bp, Artificial Sequence
  Synthesized adaptor oligonucleotide
  misc_feature (34)..(36): n is a, c, g, or t
tgcaggaccagagaattcgaatacaacatacgcnnngatcgacatg

SEQ ID NO: 5439 - DNA, 46 bp, Artificial Sequence
  Synthesized adaptor oligonucleotide
  misc_feature (34)..(36): n is a, c, g, or t
tgcaggaccagagaattcgaatacagtcgaaagnnngatcgacatg

SEQ ID NO: 5440 - DNA, 46 bp, Artificial Sequence
  Synthesized adaptor oligonucleotide
  misc_feature (34)..(36): n is a, c, g, or t
tgcaggaccagagaattcgaatacattctagttnnngatcgacatg

SEQ ID NO: 5441 - DNA, 46 bp, Artificial Sequence
  Synthesized adaptor oligonucleotide
  misc_feature (34)..(36): n is a, c, g, or t
tgcaggaccagagaattcgaatacacacgctccnnngatcgacatg

SEQ ID NO: 5442 - DNA, 46 bp, Artificial Sequence
  Synthesized adaptor oligonucleotide
  misc_feature (34)..(36): n is a, c, g, or t
tgcaggaccagagaattcgaatacaccgaggtcnnngatcgacatg

SEQ ID NO: 5443 - DNA, 46 bp, Artificial Sequence
  Synthesized adaptor oligonucleotide
  misc_feature (34)..(36): n is a, c, g, or t
tgcaggaccagagaattcgaatacacattcaggnnngatcgacatg

SEQ ID NO: 5444 - DNA, 46 bp, Artificial Sequence
  Synthesized adaptor oligonucleotide
  misc_feature (34)..(36): n is a, c, g, or t
tgcaggaccagagaattcgaatacatccataggnnngatcgacatg

SEQ ID NO: 5445 - DNA, 46 bp, Artificial Sequence
  Synthesized adaptor oligonucleotide
  misc_feature (34)..(36): n is a, c, g, or t
tgcaggaccagagaattcgaatacattactcatnnngatcgacatg

SEQ ID NO: 5446 - DNA, 46 bp, Artificial Sequence
  Synthesized adaptor oligonucleotide
  misc_feature (34)..(36): n is a, c, g, or t
tgcaggaccagagaattcgaatacaatctgatannngatcgacatg

SEQ ID NO: 5447 - DNA, 46 bp, Artificial Sequence
  Synthesized adaptor oligonucleotide
  misc_feature (34)..(36): n is a, c, g, or t
tgcaggaccagagaattcgaatacagtccacttnnngatcgacatg

SEQ ID NO: 5448 - DNA, 46 bp, Artificial Sequence
  Synthesized adaptor oligonucleotide
  misc_feature (34)..(36): n is a, c, g, or t
tgcaggaccagagaattcgaatacacaggaacannngatcgacatg

SEQ ID NO: 5449 - DNA, 46 bp, Artificial Sequence
  Synthesized adaptor oligonucleotide
  misc_feature (34)..(36): n is a, c, g, or t
tgcaggaccagagaattcgaatacactagcttcnnngatcgacatg

SEQ ID NO: 5450 - DNA, 46 bp, Artificial Sequence
  Synthesized adaptor oligonucleotide
  misc_feature (34)..(36): n is a, c, g, or t
tgcaggaccagagaattcgaatacatttggcgannngatcgacatg

SEQ ID NO: 5451 - DNA, 46 bp, Artificial Sequence
  Synthesized adaptor oligonucleotide
  misc_feature (34)..(36): n is a, c, g, or t
tgcaggaccagagaattcgaatacaccggaaggnnngatcgacatg

SEQ ID NO: 5452 - DNA, 46 bp, Artificial Sequence
  Synthesized adaptor oligonucleotide
  misc_feature (34)..(36): n is a, c, g, or t
tgcaggaccagagaattcgaatacatcccaactnnngatcgacatg

SEQ ID NO: 5453 - DNA, 46 bp, Artificial Sequence
  Synthesized adaptor oligonucleotide
  misc_feature (34)..(36): n is a, c, g, or t
tgcaggaccagagaattcgaatacattcacggannngatcgacatg

SEQ ID NO: 5454 - DNA, 46 bp, Artificial Sequence
  Synthesized adaptor oligonucleotide
  misc_feature (34)..(36): n is a, c, g, or t
tgcaggaccagagaattcgaatacaattttaccnnngatcgacatg

SEQ ID NO: 5455 - DNA, 46 bp, Artificial Sequence
  Synthesized adaptor oligonucleotide
  misc_feature (34)..(36): n is a, c, g, or t
tgcaggaccagagaattcgaatacatggagtctnnngatcgacatg

SEQ ID NO: 5456 - DNA, 46 bp, Artificial Sequence
  Synthesized adaptor oligonucleotide
  misc_feature (34)..(36): n is a, c, g, or t
tgcaggaccagagaattcgaatacacgacgaccnnngatcgacatg

SEQ ID NO: 5457 - DNA, 46 bp, Artificial Sequence
  Synthesized adaptor oligonucleotide
  misc_feature (34)..(36): n is a, c, g, or t
tgcaggaccagagaattcgaatacatcccatacnnngatcgacatg

SEQ ID NO: 5458 - DNA, 46 bp, Artificial Sequence
  Synthesized adaptor oligonucleotide
  misc_feature (34)..(36): n is a, c, g, or t
tgcaggaccagagaattcgaatacagcccttatnnngatcgacatg

SEQ ID NO: 5459 - DNA, 46 bp, Artificial Sequence
  Synthesized adaptor oligonucleotide
  misc_feature (34)..(36): n is a, c, g, or t
tgcaggaccagagaattcgaatacagtcccgctnnngatcgacatg

SEQ ID NO: 5460 - DNA, 46 bp, Artificial Sequence
  Synthesized adaptor oligonucleotide
  misc_feature (34)..(36): n is a, c, g, or t
tgcaggaccagagaattcgaatacacggcccttnnngatcgacatg

SEQ ID NO: 5461 - DNA, 46 bp, Artificial Sequence
  Synthesized adaptor oligonucleotide
  misc_feature (34)..(36): n is a, c, g, or t
tgcaggaccagagaattcgaatacatcagcttcnnngatcgacatg

SEQ ID NO: 5462 - DNA, 46 bp, Artificial Sequence
  Synthesized adaptor oligonucleotide
  misc_feature (34)..(36): n is a, c, g, or t
tgcaggaccagagaattcgaatacaggctcggtnnngatcgacatg

SEQ ID NO: 5463 - DNA, 46 bp, Artificial Sequence
  Synthesized adaptor oligonucleotide
  misc_feature (34)..(36): n is a, c, g, or t
tgcaggaccagagaattcgaatacaaagttcgcnnngatcgacatg

SEQ ID NO: 5464 - DNA, 46 bp, Artificial Sequence
  Synthesized adaptor oligonucleotide
  misc_feature (34)..(36): n is a, c, g, or t
tgcaggaccagagaattcgaatacaaacgccgcnnngatcgacatg

SEQ ID NO: 5465 - DNA, 46 bp, Artificial Sequence
  Synthesized adaptor oligonucleotide
  misc_feature (34)..(36): n is a, c, g, or t
tgcaggaccagagaattcgaatacattactatcnnngatcgacatg

SEQ ID NO: 5466 - DNA, 46 bp, Artificial Sequence
  Synthesized adaptor oligonucleotide
  misc_feature (34)..(36): n is a, c, g, or t
tgcaggaccagagaattcgaatacattcaagatnnngatcgacatg

SEQ ID NO: 5467 - DNA, 46 bp, Artificial Sequence
  Synthesized adaptor oligonucleotide
  misc_feature (34)..(36): n is a, c, g, or t
tgcaggaccagagaattcgaatacactcagttcnnngatcgacatg

SEQ ID NO: 5468 - DNA, 46 bp, Artificial Sequence
  Synthesized adaptor oligonucleotide
  misc_feature (34)..(36): n is a, c, g, or t
tgcaggaccagagaattcgaatacaaagaattgnnngatcgacatg

SEQ ID NO: 5469 - DNA, 46 bp, Artificial Sequence
  Synthesized adaptor oligonucleotide
  misc_feature (34)..(36): n is a, c, g, or t
tgcaggaccagagaattcgaatacagactaccannntgcatcaggt

SEQ ID NO: 5470 - DNA, 46 bp, Artificial Sequence
  Synthesized adaptor oligonucleotide
  misc_feature (34)..(36): n is a, c, g, or t
tgcaggaccagagaattcgaatacacacgctaannntgcatcaggt

SEQ ID NO: 5471 - DNA, 46 bp, Artificial Sequence
  Synthesized adaptor oligonucleotide
  misc_feature (34)..(36): n is a, c, g, or t
tgcaggaccagagaattcgaatacaagtcatatnnntgcatcaggt

SEQ ID NO: 5472 - DNA, 46 bp, Artificial Sequence
  Synthesized adaptor oligonucleotide
  misc_feature (34)..(36): n is a, c, g, or t
tgcaggaccagagaattcgaatacatctaggacnnntgcatcaggt

SEQ ID NO: 5473 - DNA, 46 bp, Artificial Sequence
  Synthesized adaptor oligonucleotide
  misc_feature (34)..(36): n is a, c, g, or t
tgcaggaccagagaattcgaatacaagaactttnnntgcatcaggt

SEQ ID NO: 5474 - DNA, 46 bp, Artificial Sequence
  Synthesized adaptor oligonucleotide
  misc_feature (34)..(36): n is a, c, g, or t
tgcaggaccagagaattcgaatacaaccactgannntgcatcaggt

SEQ ID NO: 5475 - DNA, 46 bp, Artificial Sequence
  Synthesized adaptor oligonucleotide
  misc_feature (34)..(36): n is a, c, g, or t
tgcaggaccagagaattcgaatacaacacgatcnnntgcatcaggt

SEQ ID NO: 5476 - DNA, 46 bp, Artificial Sequence
  Synthesized adaptor oligonucleotide
  misc_feature (34)..(36): n is a, c, g, or t
tgcaggaccagagaattcgaatacagttaccagnnntgcatcaggt

SEQ ID NO: 5477 - DNA, 46 bp, Artificial Sequence
  Synthesized adaptor oligonucleotide
  misc_feature (34)..(36): n is a, c, g, or t
tgcaggaccagagaattcgaatacacgctacccnnntgcatcaggt

SEQ ID NO: 5478 - DNA, 46 bp, Artificial Sequence
  Synthesized adaptor oligonucleotide
  misc_feature (34)..(36): n is a, c, g, or t
tgcaggaccagagaattcgaatacaagaggtacnnntgcatcaggt

SEQ ID NO: 5479 - DNA, 46 bp, Artificial Sequence
  Synthesized adaptor oligonucleotide
  misc_feature (34)..(36): n is a, c, g, or t
tgcaggaccagagaattcgaatacaaatctcttnnntgcatcaggt

SEQ ID NO: 5480 - DNA, 46 bp, Artificial Sequence
  Synthesized adaptor oligonucleotide
  misc_feature (34)..(36): n is a, c, g, or t
tgcaggaccagagaattcgaatacaatatttaannntgcatcaggt

SEQ ID NO: 5481 - DNA, 46 bp, Artificial Sequence
  Synthesized adaptor oligonucleotide
  misc_feature (34)..(36): n is a, c, g, or t
tgcaggaccagagaattcgaatacatatcgaatnnntgcatcaggt

SEQ ID NO: 5482 - DNA, 46 bp, Artificial Sequence
  Synthesized adaptor oligonucleotide
  misc_feature (34)..(36): n is a, c, g, or t
tgcaggaccagagaattcgaatacagctaaattnnntgcatcaggt

SEQ ID NO: 5483 - DNA, 46 bp, Artificial Sequence
  Synthesized adaptor oligonucleotide
  misc_feature (34)..(36): n is a, c, g, or t
tgcaggaccagagaattcgaatacatttcagccnnntgcatcaggt

SEQ ID NO: 5484 - DNA, 46 bp, Artificial Sequence
  Synthesized adaptor oligonucleotide
  misc_feature (34)..(36): n is a, c, g, or t
tgcaggaccagagaattcgaatacagttcacagnnntgcatcaggt

SEQ ID NO: 5485 - DNA, 46 bp, Artificial Sequence
  Synthesized adaptor oligonucleotide
  misc_feature (34)..(36): n is a, c, g, or t
tgcaggaccagagaattcgaatacagcattcctnnntgcatcaggt

SEQ ID NO: 5486 - DNA, 46 bp, Artificial Sequence
  Synthesized adaptor oligonucleotide
  misc_feature (34)..(36): n is a, c, g, or t
tgcaggaccagagaattcgaatacattacacccnnntgcatcaggt

SEQ ID NO: 5487 - DNA, 46 bp, Artificial Sequence
  Synthesized adaptor oligonucleotide
  misc_feature (34)..(36): n is a, c, g, or t
tgcaggaccagagaattcgaatacatattttatnnntgcatcaggt

SEQ ID NO: 5488 - DNA, 46 bp, Artificial Sequence
  Synthesized adaptor oligonucleotide
  misc_feature (34)..(36): n is a, c, g, or t
tgcaggaccagagaattcgaatacatgtccgccnnntgcatcaggt

SEQ ID NO: 5489 - DNA, 46 bp, Artificial Sequence
  Synthesized adaptor oligonucleotide
  misc_feature (34)..(36): n is a, c, g, or t
tgcaggaccagagaattcgaatacaaaacccgtnnntgcatcaggt

SEQ ID NO: 5490 - DNA, 46 bp, Artificial Sequence
  Synthesized adaptor oligonucleotide
  misc_feature (34)..(36): n is a, c, g, or t
tgcaggaccagagaattcgaatacagtaccgatnnntgcatcaggt

SEQ ID NO: 5491 - DNA, 46 bp, Artificial Sequence
  Synthesized adaptor oligonucleotide
  misc_feature (34)..(36): n is a, c, g, or t
tgcaggaccagagaattcgaatacacgcgttccnnntgcatcaggt

SEQ ID NO: 5492 - DNA, 46 bp, Artificial Sequence
  Synthesized adaptor oligonucleotide
  misc_feature (34)..(36): n is a, c, g, or t
tgcaggaccagagaattcgaatacactccaatcnnntgcatcaggt

SEQ ID NO: 5493 - DNA, 46 bp, Artificial Sequence
  Synthesized adaptor oligonucleotide
  misc_feature (34)..(36): n is a, c, g, or t
tgcaggaccagagaattcgaatacaccgcagacnnntgcatcaggt

SEQ ID NO: 5494 - DNA, 46 bp, Artificial Sequence
  Synthesized adaptor oligonucleotide
  misc_feature (34)..(36): n is a, c, g, or t
tgcaggaccagagaattcgaatacacgcttagannntgcatcaggt

SEQ ID NO: 5495 - DNA, 46 bp, Artificial Sequence
  Synthesized adaptor oligonucleotide
  misc_feature (34)..(36): n is a, c, g, or t
tgcaggaccagagaattcgaatacagaaaagccnnntgcatcaggt

SEQ ID NO: 5496 - DNA, 46 bp, Artificial Sequence
  Synthesized adaptor oligonucleotide
  misc_feature (34)..(36): n is a, c, g, or t
tgcaggaccagagaattcgaatacactcatccannntgcatcaggt

SEQ ID NO: 5497 - DNA, 46 bp, Artificial Sequence
  Synthesized adaptor oligonucleotide
  misc_feature (34)..(36): n is a, c, g, or t
tgcaggaccagagaattcgaatacaaagagtatnnntgcatcaggt

SEQ ID NO: 5498 - DNA, 46 bp, Artificial Sequence
  Synthesized adaptor oligonucleotide
  misc_feature (34)..(36): n is a, c, g, or t
tgcaggaccagagaattcgaatacaaattgtcannntgcatcaggt

SEQ ID NO: 5499 - DNA, 46 bp, Artificial Sequence
  Synthesized adaptor oligonucleotide
  misc_feature (34)..(36): n is a, c, g, or t
tgcaggaccagagaattcgaatacaataataccnnntgcatcaggt

SEQ ID NO: 5500 - DNA, 46 bp, Artificial Sequence
  Synthesized adaptor oligonucleotide
  misc_feature (34)..(36): n is a, c, g, or t
tgcaggaccagagaattcgaatacaaattttggnnntgcatcaggt

SEQ ID NO: 5501 - DNA, 46 bp, Artificial Sequence
  Synthesized adaptor oligonucleotide
  misc_feature (34)..(36): n is a, c, g, or t
tgcaggaccagagaattcgaatacagcacagttnnntgcatcaggt

SEQ ID NO: 5502 - DNA, 46 bp, Artificial Sequence
  Synthesized adaptor oligonucleotide
  misc_feature (34)..(36): n is a, c, g, or t
tgcaggaccagagaattcgaatacattaaaccannntgcatcaggt

SEQ ID NO: 5503 - DNA, 46 bp, Artificial Sequence
  Synthesized adaptor oligonucleotide
  misc_feature (34)..(36): n is a, c, g, or t
tgcaggaccagagaattcgaatacaatggagacnnntgcatcaggt

SEQ ID NO: 5504 - DNA, 46 bp, Artificial Sequence
  Synthesized adaptor oligonucleotide
  misc_feature (34)..(36): n is a, c, g, or t
tgcaggaccagagaattcgaatacaaaagacgcnnntgcatcaggt

SEQ ID NO: 5505 - DNA, 46 bp, Artificial Sequence
  Synthesized adaptor oligonucleotide
  misc_feature (34)..(36): n is a, c, g, or t
tgcaggaccagagaattcgaatacaatccgaacnnntgcatcaggt

SEQ ID NO: 5506 - DNA, 46 bp, Artificial Sequence
  Synthesized adaptor oligonucleotide
  misc_feature (34)..(36): n is a, c, g, or t
tgcaggaccagagaattcgaatacagttaggagnnntgcatcaggt

SEQ ID NO: 5507 - DNA, 46 bp, Artificial Sequence
  Synthesized adaptor oligonucleotide
  misc_feature (34)..(36): n is a, c, g, or t
tgcaggaccagagaattcgaatacatggccagcnnntgcatcaggt

SEQ ID NO: 5508 - DNA, 46 bp, Artificial Sequence
  Synthesized adaptor oligonucleotide
  misc_feature (34)..(36): n is a, c, g, or t
tgcaggaccagagaattcgaatacaatgtgcacnnntgcatcaggt

SEQ ID NO: 5509 - DNA, 46 bp, Artificial Sequence
  Synthesized adaptor oligonucleotide
  misc_feature (34)..(36): n is a, c, g, or t
tgcaggaccagagaattcgaatacagtacaaccnnntgcatcaggt

SEQ ID NO: 5510 - DNA, 46 bp, Artificial Sequence
  Synthesized adaptor oligonucleotide
  misc_feature (34)..(36): n is a, c, g, or t
tgcaggaccagagaattcgaatacagtggcgagnnntgcatcaggt

SEQ ID NO: 5511 - DNA, 46 bp, Artificial Sequence
  Synthesized adaptor oligonucleotide
  misc_feature (34)..(36): n is a, c, g, or t
tgcaggaccagagaattcgaatacaagctctctnnntgcatcaggt

SEQ ID NO: 5512 - DNA, 46 bp, Artificial Sequence
  Synthesized adaptor oligonucleotide
  misc_feature (34)..(36): n is a, c, g, or t
tgcaggaccagagaattcgaatacaacctcttgnnntgcatcaggt

SEQ ID NO: 5513 - DNA, 46 bp, Artificial Sequence
  Synthesized adaptor oligonucleotide
  misc_feature (34)..(36): n is a, c, g, or t
tgcaggaccagagaattcgaatacatcagcgtannntgcatcaggt

SEQ ID NO: 5514 - DNA, 46 bp, Artificial Sequence
  Synthesized adaptor oligonucleotide
  misc_feature (34)..(36): n is a, c, g, or t
tgcaggaccagagaattcgaatacatcagacgtnnntgcatcaggt

SEQ ID NO: 5515 - DNA, 46 bp, Artificial Sequence
  Synthesized adaptor oligonucleotide
  misc_feature (34)..(36): n is a, c, g, or t
tgcaggaccagagaattcgaatacatatagatcnnntgcatcaggt

SEQ ID NO: 5516 - DNA, 46 bp, Artificial Sequence
  Synthesized adaptor oligonucleotide
  misc_feature (34)..(36): n is a, c, g, or t
tgcaggaccagagaattcgaatacaacccgcctnnntgcatcaggt

SEQ ID NO: 5517 - DNA, 46 bp, Artificial Sequence
  Synthesized adaptor oligonucleotide
  misc_feature (34)..(36): n is a, c, g, or t
tgcaggaccagagaattcgaatacagcaggatannntgcatcaggt

SEQ ID NO: 5518 - DNA, 46 bp, Artificial Sequence
  Synthesized adaptor oligonucleotide
  misc_feature (34)..(36): n is a, c, g, or t
tgcaggaccagagaattcgaatacaagaatgcgnnntgcatcaggt

SEQ ID NO: 5519 - DNA, 46 bp, Artificial Sequence
  Synthesized adaptor oligonucleotide
  misc_feature (34)..(36): n is a, c, g, or t
tgcaggaccagagaattcgaatacaacaagtggnnntgcatcaggt

SEQ ID NO: 5520 - DNA, 46 bp, Artificial Sequence
  Synthesized adaptor oligonucleotide
  misc_feature (34)..(36): n is a, c, g, or t
tgcaggaccagagaattcgaatacagtccggcannntgcatcaggt

SEQ ID NO: 5521 - DNA, 46 bp, Artificial Sequence
  Synthesized adaptor oligonucleotide
  misc_feature (34)..(36): n is a, c, g, or t
tgcaggaccagagaattcgaatacagccctgagnnntgcatcaggt

SEQ ID NO: 5522 - DNA, 46 bp, Artificial Sequence
  Synthesized adaptor oligonucleotide
  misc_feature (34)..(36): n is a, c, g, or t
tgcaggaccagagaattcgaatacaaactatgtnnntgcatcaggt

SEQ ID NO: 5523 - DNA, 46 bp, Artificial Sequence
  Synthesized adaptor oligonucleotide
  misc_feature (34)..(36): n is a, c, g, or t
tgcaggaccagagaattcgaatacatctgatccnnntgcatcaggt

SEQ ID NO: 5524 - DNA, 46 bp, Artificial Sequence
  Synthesized adaptor oligonucleotide
  misc_feature (34)..(36): n is a, c, g, or t
tgcaggaccagagaattcgaatacataatagagnnntgcatcaggt

SEQ ID NO: 5525 - DNA, 46 bp, Artificial Sequence
  Synthesized adaptor oligonucleotide
  misc_feature (34)..(36): n is a, c, g, or t
tgcaggaccagagaattcgaatacaggccgttgnnntgcatcaggt

SEQ ID NO: 5526 - DNA, 46 bp, Artificial Sequence
  Synthesized adaptor oligonucleotide
  misc_feature (34)..(36): n is a, c, g, or t
tgcaggaccagagaattcgaatacacaacaaggnnntgcatcaggt

SEQ ID NO: 5527 - DNA, 46 bp, Artificial Sequence
  Synthesized adaptor oligonucleotide
  misc_feature (34)..(36): n is a, c, g, or t
tgcaggaccagagaattcgaatacaccctgaaannntgcatcaggt

SEQ ID NO: 5528 - DNA, 46 bp, Artificial Sequence
  Synthesized adaptor oligonucleotide
  misc_feature (34)..(36): n is a, c, g, or t
tgcaggaccagagaattcgaatacactgctgttnnntgcatcaggt

SEQ ID NO: 5529 - DNA, 46 bp, Artificial Sequence
  Synthesized adaptor oligonucleotide
  misc_feature (34)..(36): n is a, c, g, or t
tgcaggaccagagaattcgaatacagttgcgcgnnnacgtatgcca

SEQ ID NO: 5530 - DNA, 46 bp, Artificial Sequence
  Synthesized adaptor oligonucleotide
  misc_feature (34)..(36): n is a, c, g, or t
tgcaggaccagagaattcgaatacaggaacatgnnnacgtatgcca

SEQ ID NO: 5531 - DNA, 46 bp, Artificial Sequence
  Synthesized adaptor oligonucleotide
  misc_feature (34)..(36): n is a, c, g, or t
tgcaggaccagagaattcgaatacacggtaactnnnacgtatgcca

SEQ ID NO: 5532 - DNA, 46 bp, Artificial Sequence
  Synthesized adaptor oligonucleotide
  misc_feature (34)..(36): n is a, c, g, or t
tgcaggaccagagaattcgaatacaatgtgtgcnnnacgtatgcca

SEQ ID NO: 5533 - DNA, 46 bp, Artificial Sequence
  Synthesized adaptor oligonucleotide
  misc_feature (34)..(36): n is a, c, g, or t
tgcaggaccagagaattcgaatacacgagttgtnnnacgtatgcca

SEQ ID NO: 5534 - DNA, 46 bp, Artificial Sequence
  Synthesized adaptor oligonucleotide
  misc_feature (34)..(36): n is a, c, g, or t
tgcaggaccagagaattcgaatacatgaactcgnnnacgtatgcca

SEQ ID NO: 5535 - DNA, 46 bp, Artificial Sequence
  Synthesized adaptor oligonucleotide
  misc_feature (34)..(36): n is a, c, g, or t
tgcaggaccagagaattcgaatacaacatcgcannnacgtatgcca

SEQ ID NO: 5536 - DNA, 46 bp, Artificial Sequence
  Synthesized adaptor oligonucleotide
  misc_feature (34)..(36): n is a, c, g, or t
tgcaggaccagagaattcgaatacagaattgttnnnacgtatgcca

SEQ ID NO: 5537 - DNA, 46 bp, Artificial Sequence
  Synthesized adaptor oligonucleotide
  misc_feature (34)..(36): n is a, c, g, or t
tgcaggaccagagaattcgaatacaaaacacttnnnacgtatgcca

SEQ ID NO: 5538 - DNA, 46 bp, Artificial Sequence
  Synthesized adaptor oligonucleotide
  misc_feature (34)..(36): n is a, c, g, or t
tgcaggaccagagaattcgaatacatgtttgccnnnacgtatgcca

SEQ ID NO: 5539 - DNA, 46 bp, Artificial Sequence
  Synthesized adaptor oligonucleotide
  misc_feature (34)..(36): n is a, c, g, or t
tgcaggaccagagaattcgaatacacgcgtgcannnacgtatgcca

SEQ ID NO: 5540 - DNA, 46 bp, Artificial Sequence
  Synthesized adaptor oligonucleotide
  misc_feature (34)..(36): n is a, c, g, or t
tgcaggaccagagaattcgaatacagtaatgccnnnacgtatgcca

SEQ ID NO: 5541 - DNA, 46 bp, Artificial Sequence
  Synthesized adaptor oligonucleotide
  misc_feature (34)..(36): n is a, c, g, or t
tgcaggaccagagaattcgaatacagttcagacnnnacgtatgcca

SEQ ID NO: 5542 - DNA, 46 bp, Artificial Sequence
  Synthesized adaptor oligonucleotide
  misc_feature (34)..(36): n is a, c, g, or t
tgcaggaccagagaattcgaatacataatcagtnnnacgtatgcca

SEQ ID NO: 5543 - DNA, 46 bp, Artificial Sequence
  Synthesized adaptor oligonucleotide
  misc_feature (34)..(36): n is a, c, g, or t
tgcaggaccagagaattcgaatacattcccaacnnnacgtatgcca

SEQ ID NO: 5544 - DNA, 46 bp, Artificial Sequence
  Synthesized adaptor oligonucleotide
  misc_feature (34)..(36): n is a, c, g, or t
tgcaggaccagagaattcgaatacactagtagcnnnacgtatgcca

SEQ ID NO: 5545 - DNA, 46 bp, Artificial Sequence
  Synthesized adaptor oligonucleotide
  misc_feature (34)..(36): n is a, c, g, or t
tgcaggaccagagaattcgaatacattaatacgnnnacgtatgcca

SEQ ID NO: 5546 - DNA, 46 bp, Artificial Sequence
  Synthesized adaptor oligonucleotide
  misc_feature (34)..(36): n is a, c, g, or t
tgcaggaccagagaattcgaatacatacagaggnnnacgtatgcca

SEQ ID NO: 5547 - DNA, 46 bp, Artificial Sequence
  Synthesized adaptor oligonucleotide
  misc_feature (34)..(36): n is a, c, g, or t
tgcaggaccagagaattcgaatacacggcaccannnacgtatgcca

SEQ ID NO: 5548 - DNA, 46 bp, Artificial Sequence
  Synthesized adaptor oligonucleotide
  misc_feature (34)..(36): n is a, c, g, or t
tgcaggaccagagaattcgaatacatctcccaannnacgtatgcca

SEQ ID NO: 5549 - DNA, 46 bp, Artificial Sequence
  Synthesized adaptor oligonucleotide
  misc_feature (34)..(36): n is a, c, g, or t
tgcaggaccagagaattcgaatacagtactgcannnacgtatgcca

SEQ ID NO: 5550 - DNA, 46 bp, Artificial Sequence
  Synthesized adaptor oligonucleotide
  misc_feature (34)..(36): n is a, c, g, or t
tgcaggaccagagaattcgaatacagtagtaccnnnacgtatgcca

SEQ ID NO: 5551 - DNA, 46 bp, Artificial Sequence
  Synthesized adaptor oligonucleotide
  misc_feature (34)..(36): n is a, c, g, or t
tgcaggaccagagaattcgaatacataaccgtgnnnacgtatgcca

SEQ ID NO: 5552 - DNA, 46 bp, Artificial Sequence
  Synthesized adaptor oligonucleotide
  misc_feature (34)..(36): n is a, c, g, or t
tgcaggaccagagaattcgaatacacggatagannnacgtatgcca

SEQ ID NO: 5553 - DNA, 46 bp, Artificial Sequence
  Synthesized adaptor oligonucleotide
  misc_feature (34)..(36): n is a, c, g, or t
tgcaggaccagagaattcgaatacaggaatagcnnnacgtatgcca

SEQ ID NO: 5554 - DNA, 46 bp, Artificial Sequence
  Synthesized adaptor oligonucleotide
  misc_feature (34)..(36): n is a, c, g, or t
tgcaggaccagagaattcgaatacaggagtcaannnacgtatgcca

SEQ ID NO: 5555 - DNA, 46 bp, Artificial Sequence
  Synthesized adaptor oligonucleotide
  misc_feature (34)..(36): n is a, c, g, or t
tgcaggaccagagaattcgaatacaattagctannnacgtatgcca

SEQ ID NO: 5556 - DNA, 46 bp, Artificial Sequence
  Synthesized adaptor oligonucleotide
  misc_feature (34)..(36): n is a, c, g, or t
tgcaggaccagagaattcgaatacaagacatttnnnacgtatgcca

SEQ ID NO: 5557 - DNA, 46 bp, Artificial Sequence
  Synthesized adaptor oligonucleotide
  misc_feature (34)..(36): n is a, c, g, or t
tgcaggaccagagaattcgaatacatctacgctnnnacgtatgcca

SEQ ID NO: 5558 - DNA, 46 bp, Artificial Sequence
  Synthesized adaptor oligonucleotide
  misc_feature (34)..(36): n is a, c, g, or t
tgcaggaccagagaattcgaatacatgccttcannnacgtatgcca

SEQ ID NO: 5559 - DNA, 46 bp, Artificial Sequence
  Synthesized adaptor oligonucleotide
  misc_feature (34)..(36): n is a, c, g, or t
tgcaggaccagagaattcgaatacaagatcaccnnnacgtatgcca

SEQ ID NO: 5560 - DNA, 46 bp, Artificial Sequence
  Synthesized adaptor oligonucleotide
  misc_feature (34)..(36): n is a, c, g, or t
tgcaggaccagagaattcgaatacaatcctttannnacgtatgcca

SEQ ID NO: 5561 - DNA, 46 bp, Artificial Sequence
  Synthesized adaptor oligonucleotide
  misc_feature (34)..(36): n is a, c, g, or t
tgcaggaccagagaattcgaatacagtagttcgnnnacgtatgcca

SEQ ID NO: 5562 - DNA, 46 bp, Artificial Sequence
  Synthesized adaptor oligonucleotide
  misc_feature (34)..(36): n is a, c, g, or t
tgcaggaccagagaattcgaatacaggcccggcnnnacgtatgcca

SEQ ID NO: 5563 - DNA, 46 bp, Artificial Sequence
  Synthesized adaptor oligonucleotide
  misc_feature (34)..(36): n is a, c, g, or t
tgcaggaccagagaattcgaatacaaggccaggnnnacgtatgcca

SEQ ID NO: 5564 - DNA, 46 bp, Artificial Sequence
  Synthesized adaptor oligonucleotide
  misc_feature (34)..(36): n is a, c, g, or t
tgcaggaccagagaattcgaatacattgtcaggnnnacgtatgcca

SEQ ID NO: 5565 - DNA, 46 bp, Artificial Sequence
  Synthesized adaptor oligonucleotide
  misc_feature (34)..(36): n is a, c, g, or t
tgcaggaccagagaattcgaatacaaaatctgtnnnacgtatgcca

SEQ ID NO: 5566 - DNA, 46 bp, Artificial Sequence
  Synthesized adaptor oligonucleotide
  misc_feature (34)..(36): n is a, c, g, or t
tgcaggaccagagaattcgaatacaataaaaatnnnacgtatgcca

SEQ ID NO: 5567 - DNA, 46 bp, Artificial Sequence
  Synthesized adaptor oligonucleotide
  misc_feature (34)..(36): n is a, c, g, or t
tgcaggaccagagaattcgaatacatgtcacagnnnacgtatgcca

SEQ ID NO: 5568 - DNA, 46 bp, Artificial Sequence
  Synthesized adaptor oligonucleotide
  misc_feature (34)..(36): n is a, c, g, or t
tgcaggaccagagaattcgaatacatctcatgcnnnacgtatgcca

SEQ ID NO: 5569 - DNA, 46 bp, Artificial Sequence
  Synthesized adaptor oligonucleotide
  misc_feature (34)..(36): n is a, c, g, or t
tgcaggaccagagaattcgaatacagaacgcttnnnacgtatgcca

SEQ ID NO: 5570 - DNA, 46 bp, Artificial Sequence
  Synthesized adaptor oligonucleotide
  misc_feature (34)..(36): n is a, c, g, or t
tgcaggaccagagaattcgaatacatctcagctnnnacgtatgcca

SEQ ID NO: 5571 - DNA, 46 bp, Artificial Sequence
  Synthesized adaptor oligonucleotide
  misc_feature (34)..(36): n is a, c, g, or t
tgcaggaccagagaattcgaatacagatgcgaannnacgtatgcca

SEQ ID NO: 5572 - DNA, 46 bp, Artificial Sequence
  Synthesized adaptor oligonucleotide
  misc_feature (34)..(36): n is a, c, g, or t
tgcaggaccagagaattcgaatacactctatcgnnnacgtatgcca

SEQ ID NO: 5573 - DNA, 46 bp, Artificial Sequence
  Synthesized adaptor oligonucleotide
  misc_feature (34)..(36): n is a, c, g, or t
tgcaggaccagagaattcgaatacagacggtaannnacgtatgcca

SEQ ID NO: 5574 - DNA, 46 bp, Artificial Sequence
  Synthesized adaptor oligonucleotide
  misc_feature (34)..(36): n is a, c, g, or t
tgcaggaccagagaattcgaatacatatattttnnnacgtatgcca

SEQ ID NO: 5575 - DNA, 46 bp, Artificial Sequence
  Synthesized adaptor oligonucleotide
  misc_feature (34)..(36): n is a, c, g, or t
tgcaggaccagagaattcgaatacatgcattccnnnacgtatgcca

SEQ ID NO: 5576 - DNA, 46 bp, Artificial Sequence
  Synthesized adaptor oligonucleotide
  misc_feature (34)..(36): n is a, c, g, or t
tgcaggaccagagaattcgaatacatatatctcnnnacgtatgcca

SEQ ID NO: 5577 - DNA, 46 bp, Artificial Sequence
  Synthesized adaptor oligonucleotide
  misc_feature (34)..(36): n is a, c, g, or t
tgcaggaccagagaattcgaatacaccggctgannnacgtatgcca

SEQ ID NO: 5578 - DNA, 46 bp, Artificial Sequence
  Synthesized adaptor oligonucleotide
  misc_feature (34)..(36): n is a, c, g, or t
tgcaggaccagagaattcgaatacagaatcaggnnnacgtatgcca

SEQ ID NO: 5579 - DNA, 46 bp, Artificial Sequence
  Synthesized adaptor oligonucleotide
  misc_feature (34)..(36): n is a, c, g, or t
tgcaggaccagagaattcgaatacatcctagagnnnacgtatgcca

SEQ ID NO: 5580 - DNA, 46 bp, Artificial Sequence
  Synthesized adaptor oligonucleotide
  misc_feature (34)..(36): n is a, c, g, or t
tgcaggaccagagaattcgaatacaccgtgtggnnnacgtatgcca

SEQ ID NO: 5581 - DNA, 46 bp, Artificial Sequence
  Synthesized adaptor oligonucleotide
  misc_feature (34)..(36): n is a, c, g, or t
tgcaggaccagagaattcgaatacatagtttctnnnacgtatgcca

SEQ ID NO: 5582 - DNA, 46 bp, Artificial Sequence
  Synthesized adaptor oligonucleotide
  misc_feature (34)..(36): n is a, c, g, or t
tgcaggaccagagaattcgaatacagataacggnnnacgtatgcca

SEQ ID NO: 5583 - DNA, 46 bp, Artificial Sequence
  Synthesized adaptor oligonucleotide
  misc_feature (34)..(36): n is a, c, g, or t
tgcaggaccagagaattcgaatacactcgtactnnnacgtatgcca

SEQ ID NO: 5584 - DNA, 46 bp, Artificial Sequence
  Synthesized adaptor oligonucleotide
  misc_feature (34)..(36): n is a, c, g, or t
tgcaggaccagagaattcgaatacagcactttcnnnacgtatgcca

SEQ ID NO: 5585 - DNA, 46 bp, Artificial Sequence
  Synthesized adaptor oligonucleotide
  misc_feature (34)..(36): n is a, c, g, or t
tgcaggaccagagaattcgaatacagttctcgtnnnacgtatgcca

SEQ ID NO: 5586 - DNA, 46 bp, Artificial Sequence
  Synthesized adaptor oligonucleotide
  misc_feature (34)..(36): n is a, c, g, or t
tgcaggaccagagaattcgaatacacttacgtcnnnacgtatgcca

SEQ ID NO: 5587 - DNA, 46 bp, Artificial Sequence
  Synthesized adaptor oligonucleotide
  misc_feature (34)..(36): n is a, c, g, or t
tgcaggaccagagaattcgaatacacagaagacnnnacgtatgcca

SEQ ID NO: 5588 - DNA, 46 bp, Artificial Sequence
  Synthesized adaptor oligonucleotide
  misc_feature (34)..(36): n is a, c, g, or t
tgcaggaccagagaattcgaatacataagtctannnacgtatgcca

SEQ ID NO: 5589 - DNA, 46 bp, Artificial Sequence
  Synthesized adaptor oligonucleotide
  misc_feature (34)..(36): n is a, c, g, or t
tgcaggaccagagaattcgaatacacatactaannnctagcgttac

SEQ ID NO: 5590 - DNA, 46 bp, Artificial Sequence
  Synthesized adaptor oligonucleotide
  misc_feature (34)..(36): n is a, c, g, or t
tgcaggaccagagaattcgaatacaccgaatcannnctagcgttac

SEQ ID NO: 5591 - DNA, 46 bp, Artificial Sequence
  Synthesized adaptor oligonucleotide
  misc_feature (34)..(36): n is a, c, g, or t
tgcaggaccagagaattcgaatacactattttgnnnctagcgttac

SEQ ID NO: 5592 - DNA, 46 bp, Artificial Sequence
  Synthesized adaptor oligonucleotide
  misc_feature (34)..(36): n is a, c, g, or t
tgcaggaccagagaattcgaatacacccgacagnnnctagcgttac

SEQ ID NO: 5593 - DNA, 46 bp, Artificial Sequence
  Synthesized adaptor oligonucleotide
  misc_feature (34)..(36): n is a, c, g, or t
tgcaggaccagagaattcgaatacaacttcgagnnnctagcgttac

SEQ ID NO: 5594 - DNA, 46 bp, Artificial Sequence
  Synthesized adaptor oligonucleotide
  misc_feature (34)..(36): n is a, c, g, or t
tgcaggaccagagaattcgaatacatgatgctgnnnctagcgttac

SEQ ID NO: 5595 - DNA, 46 bp, Artificial Sequence
  Synthesized adaptor oligonucleotide
  misc_feature (34)..(36): n is a, c, g, or t
tgcaggaccagagaattcgaatacagcgcaggannnctagcgttac

SEQ ID NO: 5596 - DNA, 46 bp, Artificial Sequence
  Synthesized adaptor oligonucleotide
  misc_feature (34)..(36): n is a, c, g, or t
tgcaggaccagagaattcgaatacattcacaaannnctagcgttac

SEQ ID NO: 5597 - DNA, 46 bp, Artificial Sequence
  Synthesized adaptor oligonucleotide
  misc_feature (34)..(36): n is a, c, g, or t
tgcaggaccagagaattcgaatacaatgcactgnnnctagcgttac

SEQ ID NO: 5598 - DNA, 46 bp, Artificial Sequence
  Synthesized adaptor oligonucleotide
  misc_feature (34)..(36): n is a, c, g, or t
tgcaggaccagagaattcgaatacagttgccggnnnctagcgttac

SEQ ID NO: 5599 - DNA, 46 bp, Artificial Sequence
  Synthesized adaptor oligonucleotide
  misc_feature (34)..(36): n is a, c, g, or t
tgcaggaccagagaattcgaatacaattttccannnctagcgttac

SEQ ID NO: 5600 - DNA, 46 bp, Artificial Sequence
  Synthesized adaptor oligonucleotide
  misc_feature (34)..(36): n is a, c, g, or t
tgcaggaccagagaattcgaatacaccagcagcnnnctagcgttac

SEQ ID NO: 5601 - DNA, 46 bp, Artificial Sequence
  Synthesized adaptor oligonucleotide
  misc_feature (34)..(36): n is a, c, g, or t
tgcaggaccagagaattcgaatacacggacaggnnnctagcgttac

SEQ ID NO: 5602 - DNA, 46 bp, Artificial Sequence
  Synthesized adaptor oligonucleotide
  misc_feature (34)..(36): n is a, c, g, or t
tgcaggaccagagaattcgaatacatctgcgttnnnctagcgttac

SEQ ID NO: 5603 - DNA, 46 bp, Artificial Sequence
  Synthesized adaptor oligonucleotide
  misc_feature (34)..(36): n is a, c, g, or t
tgcaggaccagagaattcgaatacatttgctatnnnctagcgttac

SEQ ID NO: 5604 - DNA, 46 bp, Artificial Sequence
  Synthesized adaptor oligonucleotide
  misc_feature (34)..(36): n is a, c, g, or t
tgcaggaccagagaattcgaatacatttcctttnnnctagcgttac

SEQ ID NO: 5605 - DNA, 46 bp, Artificial Sequence
  Synthesized adaptor oligonucleotide
  misc_feature (34)..(36): n is a, c, g, or t
tgcaggaccagagaattcgaatacacgagacttnnnctagcgttac

SEQ ID NO: 5606 - DNA, 46 bp, Artificial Sequence
  Synthesized adaptor oligonucleotide
  misc_feature (34)..(36): n is a, c, g, or t
tgcaggaccagagaattcgaatacaaactagaannnctagcgttac

SEQ ID NO: 5607 - DNA, 46 bp, Artificial Sequence
  Synthesized adaptor oligonucleotide
  misc_feature (34)..(36): n is a, c, g, or t
tgcaggaccagagaattcgaatacacctcgattnnnctagcgttac

SEQ ID NO: 5608 - DNA, 46 bp, Artificial Sequence
  Synthesized adaptor oligonucleotide
  misc_feature (34)..(36): n is a, c, g, or t
tgcaggaccagagaattcgaatacagtgaagacnnnctagcgttac

SEQ ID NO: 5609 - DNA, 46 bp, Artificial Sequence
  Synthesized adaptor oligonucleotide
  misc_feature (34)..(36): n is a, c, g, or t
tgcaggaccagagaattcgaatacaacgttacgnnnctagcgttac

SEQ ID NO: 5610 - DNA, 46 bp, Artificial Sequence
  Synthesized adaptor oligonucleotide
  misc_feature (34)..(36): n is a, c, g, or t
tgcaggaccagagaattcgaatacacgtcctgcnnnctagcgttac

SEQ ID NO: 5611 - DNA, 46 bp, Artificial Sequence
  Synthesized adaptor oligonucleotide
  misc_feature (34)..(36): n is a, c, g, or t
tgcaggaccagagaattcgaatacaactcctacnnnctagcgttac

SEQ ID NO: 5612 - DNA, 46 bp, Artificial Sequence
  Synthesized adaptor oligonucleotide
  misc_feature (34)..(36): n is a, c, g, or t
tgcaggaccagagaattcgaatacagttaggtcnnnctagcgttac

SEQ ID NO: 5613 - DNA, 46 bp, Artificial Sequence
  Synthesized adaptor oligonucleotide
  misc_feature (34)..(36): n is a, c, g, or t
tgcaggaccagagaattcgaatacactcatgagnnnctagcgttac

SEQ ID NO: 5614 - DNA, 46 bp, Artificial Sequence
  Synthesized adaptor oligonucleotide
  misc_feature (34)..(36): n is a, c, g, or t
tgcaggaccagagaattcgaatacatatttaccnnnctagcgttac

SEQ ID NO: 5615 - DNA, 46 bp, Artificial Sequence
  Synthesized adaptor oligonucleotide
  misc_feature (34)..(36): n is a, c, g, or t
tgcaggaccagagaattcgaatacaccttcatgnnnctagcgttac

SEQ ID NO: 5616 - DNA, 46 bp, Artificial Sequence
  Synthesized adaptor oligonucleotide
  misc_feature (34)..(36): n is a, c, g, or t
tgcaggaccagagaattcgaatacaggactagannnctagcgttac

SEQ ID NO: 5617 - DNA, 46 bp, Artificial Sequence
  Synthesized adaptor oligonucleotide
  misc_feature (34)..(36): n is a, c, g, or t
tgcaggaccagagaattcgaatacagtggcaaannnctagcgttac

SEQ ID NO: 5618 - DNA, 46 bp, Artificial Sequence
  Synthesized adaptor oligonucleotide
  misc_feature (34)..(36): n is a, c, g, or t
tgcaggaccagagaattcgaatacaaataaacgnnnctagcgttac

SEQ ID NO: 5619 - DNA, 46 bp, Artificial Sequence
  Synthesized adaptor oligonucleotide
  misc_feature (34)..(36): n is a, c, g, or t
tgcaggaccagagaattcgaatacagtataccgnnnctagcgttac

SEQ ID NO: 5620 - DNA, 46 bp, Artificial Sequence
  Synthesized adaptor oligonucleotide
  misc_feature (34)..(36): n is a, c, g, or t
tgcaggaccagagaattcgaatacaccaaattannnctagcgttac

SEQ ID NO: 5621 - DNA, 46 bp, Artificial Sequence
  Synthesized adaptor oligonucleotide
  misc_feature (34)..(36): n is a, c, g, or t
tgcaggaccagagaattcgaatacattctttagnnnctagcgttac

SEQ ID NO: 5622 - DNA, 46 bp, Artificial Sequence
  Synthesized adaptor oligonucleotide
  misc_feature (34)..(36): n is a, c, g, or t
tgcaggaccagagaattcgaatacatgttcgtcnnnctagcgttac

SEQ ID NO: 5623 - DNA, 46 bp, Artificial Sequence
  Synthesized adaptor oligonucleotide
  misc_feature (34)..(36): n is a, c, g, or t
tgcaggaccagagaattcgaatacaccggctctnnnctagcgttac

SEQ ID NO: 5624 - DNA, 46 bp, Artificial Sequence
  Synthesized adaptor oligonucleotide
  misc_feature (34)..(36): n is a, c, g, or t
tgcaggaccagagaattcgaatacacgagtgttnnnctagcgttac

SEQ ID NO: 5625 - DNA, 46 bp, Artificial Sequence
  Synthesized adaptor oligonucleotide
  misc_feature (34)..(36): n is a, c, g, or t
tgcaggaccagagaattcgaatacagcggtattnnnctagcgttac

SEQ ID NO: 5626 - DNA, 46 bp, Artificial Sequence
  Synthesized adaptor oligonucleotide
  misc_feature (34)..(36): n is a, c, g, or t
tgcaggaccagagaattcgaatacaaagtctcgnnnctagcgttac

SEQ ID NO: 5627 - DNA, 46 bp, Artificial Sequence
  Synthesized adaptor oligonucleotide
  misc_feature (34)..(36): n is a, c, g, or t
tgcaggaccagagaattcgaatacagtagcaagnnnctagcgttac

SEQ ID NO: 5628 - DNA, 46 bp, Artificial Sequence
  Synthesized adaptor oligonucleotide
  misc_feature (34)..(36): n is a, c, g, or t
tgcaggaccagagaattcgaatacacggagagcnnnctagcgttac

SEQ ID NO: 5629 - DNA, 46 bp, Artificial Sequence
  Synthesized adaptor oligonucleotide
  misc_feature (34)..(36): n is a, c, g, or t
tgcaggaccagagaattcgaatacagcttttgcnnnctagcgttac

SEQ ID NO: 5630 - DNA, 46 bp, Artificial Sequence
  Synthesized adaptor oligonucleotide
  misc_feature (34)..(36): n is a, c, g, or t
tgcaggaccagagaattcgaatacatatgtagtnnnctagcgttac

SEQ ID NO: 5631 - DNA, 46 bp, Artificial Sequence
  Synthesized adaptor oligonucleotide
  misc_feature (34)..(36): n is a, c, g, or t
tgcaggaccagagaattcgaatacaatctctcgnnnctagcgttac

SEQ ID NO: 5632 - DNA, 46 bp, Artificial Sequence
  Synthesized adaptor oligonucleotide
  misc_feature (34)..(36): n is a, c, g, or t
tgcaggaccagagaattcgaatacagtgtttccnnnctagcgttac

SEQ ID NO: 5633 - DNA, 46 bp, Artificial Sequence
  Synthesized adaptor oligonucleotide
  misc_feature (34)..(36): n is a, c, g, or t
tgcaggaccagagaattcgaatacacgtagtacnnnctagcgttac

SEQ ID NO: 5634 - DNA, 46 bp, Artificial Sequence
  Synthesized adaptor oligonucleotide
  misc_feature (34)..(36): n is a, c, g, or t
tgcaggaccagagaattcgaatacagcggaaatnnnctagcgttac

SEQ ID NO: 5635 - DNA, 46 bp, Artificial Sequence
  Synthesized adaptor oligonucleotide
  misc_feature (34)..(36): n is a, c, g, or t
tgcaggaccagagaattcgaatacataattcagnnnctagcgttac

SEQ ID NO: 5636 - DNA, 46 bp, Artificial Sequence
  Synthesized adaptor oligonucleotide
  misc_feature (34)..(36): n is a, c, g, or t
tgcaggaccagagaattcgaatacacgcgcggcnnnctagcgttac

SEQ ID NO: 5637 - DNA, 46 bp, Artificial Sequence
  Synthesized adaptor oligonucleotide
  misc_feature (34)..(36): n is a, c, g, or t
tgcaggaccagagaattcgaatacacgaagagtnnnctagcgttac

SEQ ID NO: 5638 - DNA, 46 bp, Artificial Sequence
  Synthesized adaptor oligonucleotide
  misc_feature (34)..(36): n is a, c, g, or t
tgcaggaccagagaattcgaatacaagcgtgttnnnctagcgttac

SEQ ID NO: 5639 - DNA, 46 bp, Artificial Sequence
  Synthesized adaptor oligonucleotide
  misc_feature (34)..(36): n is a, c, g, or t
tgcaggaccagagaattcgaatacacgaaagcannnctagcgttac

SEQ ID NO: 5640 - DNA, 46 bp, Artificial Sequence
  Synthesized adaptor oligonucleotide
  misc_feature (34)..(36): n is a, c, g, or t
tgcaggaccagagaattcgaatacagtctacctnnnctagcgttac

SEQ ID NO: 5641 - DNA, 46 bp, Artificial Sequence
  Synthesized adaptor oligonucleotide
  misc_feature (34)..(36): n is a, c, g, or t
tgcaggaccagagaattcgaatacacatgcggcnnnctagcgttac

SEQ ID NO: 5642 - DNA, 46 bp, Artificial Sequence
  Synthesized adaptor oligonucleotide
  misc_feature (34)..(36): n is a, c, g, or t
tgcaggaccagagaattcgaatacatgaccggcnnnctagcgttac

SEQ ID NO: 5643 - DNA, 46 bp, Artificial Sequence
  Synthesized adaptor oligonucleotide
  misc_feature (34)..(36): n is a, c, g, or t
tgcaggaccagagaattcgaatacaactttagannnctagcgttac

SEQ ID NO: 5644 - DNA, 46 bp, Artificial Sequence
  Synthesized adaptor oligonucleotide
  misc_feature (34)..(36): n is a, c, g, or t
tgcaggaccagagaattcgaatacaagctcgcgnnnctagcgttac

SEQ ID NO: 5645 - DNA, 46 bp, Artificial Sequence
  Synthesized adaptor oligonucleotide
  misc_feature (34)..(36): n is a, c, g, or t
tgcaggaccagagaattcgaatacaagacatccnnnctagcgttac

SEQ ID NO: 5646 - DNA, 46 bp, Artificial Sequence
  Synthesized adaptor oligonucleotide
  misc_feature (34)..(36): n is a, c, g, or t
tgcaggaccagagaattcgaatacactcaatggnnnctagcgttac

SEQ ID NO: 5647 - DNA, 46 bp, Artificial Sequence
  Synthesized adaptor oligonucleotide
  misc_feature (34)..(36): n is a, c, g, or t
tgcaggaccagagaattcgaatacatattccgcnnnctagcgttac

SEQ ID NO: 5648 - DNA, 46 bp, Artificial Sequence
  Synthesized adaptor oligonucleotide
  misc_feature (34)..(36): n is a, c, g, or t
tgcaggaccagagaattcgaatacattcacctgnnnctagcgttac

SEQ ID NO: 5649 - DNA, 46 bp, Artificial Sequence
  Synthesized adaptor oligonucleotide
  misc_feature (34)..(36): n is a, c, g, or t
tgcaggaccagagaattcgaatacactctgtacnnngatcgacatg

SEQ ID NO: 5650 - DNA, 46 bp, Artificial Sequence
  Synthesized adaptor oligonucleotide
  misc_feature (34)..(36): n is a, c, g, or t
tgcaggaccagagaattcgaatacattgatttcnnngatcgacatg

SEQ ID NO: 5651 - DNA, 46 bp, Artificial Sequence
  Synthesized adaptor oligonucleotide
  misc_feature (34)..(36): n is a, c, g, or t
tgcaggaccagagaattcgaatacagcacatacnnngatcgacatg

SEQ ID NO: 5652 - DNA, 46 bp, Artificial Sequence
  Synthesized adaptor oligonucleotide
  misc_feature (34)..(36): n is a, c, g, or t
tgcaggaccagagaattcgaatacagcttgtgannngatcgacatg

SEQ ID NO: 5653 - DNA, 46 bp, Artificial Sequence
  Synthesized adaptor oligonucleotide
  misc_feature (34)..(36): n is a, c, g, or t
tgcaggaccagagaattcgaatacatacggtacnnngatcgacatg

SEQ ID NO: 5654 - DNA, 46 bp, Artificial Sequence
  Synthesized adaptor oligonucleotide
  misc_feature (34)..(36): n is a, c, g, or t
tgcaggaccagagaattcgaatacacacggtcgnnngatcgacatg

SEQ ID NO: 5655 - DNA, 46 bp, Artificial Sequence
  Synthesized adaptor oligonucleotide
  misc_feature (34)..(36): n is a, c, g, or t
tgcaggaccagagaattcgaatacaccaaggttnnngatcgacatg

SEQ ID NO: 5656 - DNA, 46 bp, Artificial Sequence
  Synthesized adaptor oligonucleotide
  misc_feature (34)..(36): n is a, c, g, or t
tgcaggaccagagaattcgaatacagttcggcgnnngatcgacatg

SEQ ID NO: 5657 - DNA, 46 bp, Artificial Sequence
  Synthesized adaptor oligonucleotide
  misc_feature (34)..(36): n is a, c, g, or t
tgcaggaccagagaattcgaatacaacgcagccnnngatcgacatg

SEQ ID NO: 5658 - DNA, 46 bp, Artificial Sequence
  Synthesized adaptor oligonucleotide
  misc_feature (34)..(36): n is a, c, g, or t
tgcaggaccagagaattcgaatacaccccgagannngatcgacatg

SEQ ID NO: 5659 - DNA, 46 bp, Artificial Sequence
  Synthesized adaptor oligonucleotide
  misc_feature (34)..(36): n is a, c, g, or t
tgcaggaccagagaattcgaatacactccatgtnnngatcgacatg

SEQ ID NO: 5660 - DNA, 46 bp, Artificial Sequence
  Synthesized adaptor oligonucleotide
  misc_feature (34)..(36): n is a, c, g, or t
tgcaggaccagagaattcgaatacatttgcaccnnngatcgacatg

SEQ ID NO: 5661 - DNA, 46 bp, Artificial Sequence
  Synthesized adaptor oligonucleotide
  misc_feature (34)..(36): n is a, c, g, or t
tgcaggaccagagaattcgaatacaattacaacnnngatcgacatg

SEQ ID NO: 5662 - DNA, 46 bp, Artificial Sequence
  Synthesized adaptor oligonucleotide
  misc_feature (34)..(36): n is a, c, g, or t
tgcaggaccagagaattcgaatacatgcccaccnnngatcgacatg

SEQ ID NO: 5663 - DNA, 46 bp, Artificial Sequence
  Synthesized adaptor oligonucleotide
  misc_feature (34)..(36): n is a, c, g, or t
tgcaggaccagagaattcgaatacagattggagnnngatcgacatg

SEQ ID NO: 5664 - DNA, 46 bp, Artificial Sequence
  Synthesized adaptor oligonucleotide
  misc_feature (34)..(36): n is a, c, g, or t
tgcaggaccagagaattcgaatacatcatacccnnngatcgacatg

SEQ ID NO: 5665 - DNA, 46 bp, Artificial Sequence
  Synthesized adaptor oligonucleotide
  misc_feature (34)..(36): n is a, c, g, or t
tgcaggaccagagaattcgaatacaggtggatannngatcgacatg

SEQ ID NO: 5666 - DNA, 46 bp, Artificial Sequence
  Synthesized adaptor oligonucleotide
  misc_feature (34)..(36): n is a, c, g, or t
tgcaggaccagagaattcgaatacagacattcgnnngatcgacatg

SEQ ID NO: 5667 - DNA, 46 bp, Artificial Sequence
  Synthesized adaptor oligonucleotide
  misc_feature (34)..(36): n is a, c, g, or t
tgcaggaccagagaattcgaatacaatctgcgannngatcgacatg

SEQ ID NO: 5668 - DNA, 46 bp, Artificial Sequence
  Synthesized adaptor oligonucleotide
  misc_feature (34)..(36): n is a, c, g, or t
tgcaggaccagagaattcgaatacaggcacccannngatcgacatg

SEQ ID NO: 5669 - DNA, 46 bp, Artificial Sequence
  Synthesized adaptor oligonucleotide
  misc_feature (34)..(36): n is a, c, g, or t
tgcaggaccagagaattcgaatacaaatgtttgnnngatcgacatg

SEQ ID NO: 5670 - DNA, 46 bp, Artificial Sequence
  Synthesized adaptor oligonucleotide
  misc_feature (34)..(36): n is a, c, g, or t
tgcaggaccagagaattcgaatacaacctggtannngatcgacatg

SEQ ID NO: 5671 - DNA, 46 bp, Artificial Sequence
  Synthesized adaptor oligonucleotide
  misc_feature (34)..(36): n is a, c, g, or t
tgcaggaccagagaattcgaatacaactgagagnnngatcgacatg

SEQ ID NO: 5672 - DNA, 46 bp, Artificial Sequence
  Synthesized adaptor oligonucleotide
  misc_feature (34)..(36): n is a, c, g, or t
tgcaggaccagagaattcgaatacagaattaagnnngatcgacatg

SEQ ID NO: 5673 - DNA, 46 bp, Artificial Sequence
  Synthesized adaptor oligonucleotide
  misc_feature (34)..(36): n is a, c, g, or t
tgcaggaccagagaattcgaatacaattacggcnnngatcgacatg

SEQ ID NO: 5674 - DNA, 46 bp, Artificial Sequence
  Synthesized adaptor oligonucleotide
  misc_feature (34)..(36): n is a, c, g, or t
tgcaggaccagagaattcgaatacacagtctagnnngatcgacatg

SEQ ID NO: 5675 - DNA, 46 bp, Artificial Sequence
  Synthesized adaptor oligonucleotide
  misc_feature (34)..(36): n is a, c, g, or t
tgcaggaccagagaattcgaatacaatcccttgnnngatcgacatg

SEQ ID NO: 5676 - DNA, 46 bp, Artificial Sequence
  Synthesized adaptor oligonucleotide
  misc_feature (34)..(36): n is a, c, g, or t
tgcaggaccagagaattcgaatacatgtccactnnngatcgacatg

SEQ ID NO: 5677 - DNA, 46 bp, Artificial Sequence
  Synthesized adaptor oligonucleotide
  misc_feature (34)..(36): n is a, c, g, or t
tgcaggaccagagaattcgaatacaggtacgccnnngatcgacatg

SEQ ID NO: 5678 - DNA, 46 bp, Artificial Sequence
  Synthesized adaptor oligonucleotide
  misc_feature (34)..(36): n is a, c, g, or t
tgcaggaccagagaattcgaatacatgagcagannngatcgacatg

SEQ ID NO: 5679 - DNA, 46 bp, Artificial Sequence
  Synthesized adaptor oligonucleotide
  misc_feature (34)..(36): n is a, c, g, or t
tgcaggaccagagaattcgaatacagatccgtannngatcgacatg

SEQ ID NO: 5680 - DNA, 46 bp, Artificial Sequence
  Synthesized adaptor oligonucleotide
  misc_feature (34)..(36): n is a, c, g, or t
tgcaggaccagagaattcgaatacatcactaaannngatcgacatg

SEQ ID NO: 5681 - DNA, 46 bp, Artificial Sequence
  Synthesized adaptor oligonucleotide
  misc_feature (34)..(36): n is a, c, g, or t
tgcaggaccagagaattcgaatacaaatagatgnnngatcgacatg

SEQ ID NO: 5682 - DNA, 46 bp, Artificial Sequence
  Synthesized adaptor oligonucleotide
  misc_feature (34)..(36): n is a, c, g, or t
tgcaggaccagagaattcgaatacatcgcgctcnnngatcgacatg

SEQ ID NO: 5683 - DNA, 46 bp, Artificial Sequence
  Synthesized adaptor oligonucleotide
  misc_feature (34)..(36): n is a, c, g, or t
tgcaggaccagagaattcgaatacaaccgacgcnnngatcgacatg

SEQ ID NO: 5684 - DNA, 46 bp, Artificial Sequence
  Synthesized adaptor oligonucleotide
  misc_feature (34)..(36): n is a, c, g, or t
tgcaggaccagagaattcgaatacacacggaccnnngatcgacatg

SEQ ID NO: 5685 - DNA, 46 bp, Artificial Sequence
  Synthesized adaptor oligonucleotide
  misc_feature (34)..(36): n is a, c, g, or t
tgcaggaccagagaattcgaatacaatatcgatnnngatcgacatg

SEQ ID NO: 5686 - DNA, 46 bp, Artificial Sequence
  Synthesized adaptor oligonucleotide
  misc_feature (34)..(36): n is a, c, g, or t
tgcaggaccagagaattcgaatacataccacgannngatcgacatg

SEQ ID NO: 5687 - DNA, 46 bp, Artificial Sequence
  Synthesized adaptor oligonucleotide
  misc_feature (34)..(36): n is a, c, g, or t
tgcaggaccagagaattcgaatacaaagaacgcnnngatcgacatg

SEQ ID NO: 5688 - DNA, 46 bp, Artificial Sequence
  Synthesized adaptor oligonucleotide
  misc_feature (34)..(36): n is a, c, g, or t
tgcaggaccagagaattcgaatacaagtacctgnnngatcgacatg

SEQ ID NO: 5689 - DNA, 46 bp, Artificial Sequence
  Synthesized adaptor oligonucleotide
  misc_feature (34)..(36): n is a, c, g, or t
tgcaggaccagagaattcgaatacagttttagannngatcgacatg

SEQ ID NO: 5690 - DNA, 46 bp, Artificial Sequence
  Synthesized adaptor oligonucleotide
  misc_feature (34)..(36): n is a, c, g, or t
tgcaggaccagagaattcgaatacaggattttannngatcgacatg

SEQ ID NO: 5691 - DNA, 46 bp, Artificial Sequence
  Synthesized adaptor oligonucleotide
  misc_feature (34)..(36): n is a, c, g, or t
tgcaggaccagagaattcgaatacatagtatacnnngatcgacatg

SEQ ID NO: 5692 - DNA, 46 bp, Artificial Sequence
  Synthesized adaptor oligonucleotide
  misc_feature (34)..(36): n is a, c, g, or t
tgcaggaccagagaattcgaatacacgtatggtnnngatcgacatg

SEQ ID NO: 5693 - DNA, 46 bp, Artificial Sequence
  Synthesized adaptor oligonucleotide
  misc_feature (34)..(36): n is a, c, g, or t
tgcaggaccagagaattcgaatacatcccggctnnngatcgacatg

SEQ ID NO: 5694 - DNA, 46 bp, Artificial Sequence
  Synthesized adaptor oligonucleotide
  misc_feature (34)..(36): n is a, c, g, or t
tgcaggaccagagaattcgaatacagcgctctcnnngatcgacatg

SEQ ID NO: 5695 - DNA, 46 bp, Artificial Sequence
  Synthesized adaptor oligonucleotide
  misc_feature (34)..(36): n is a, c, g, or t
tgcaggaccagagaattcgaatacacattcccannngatcgacatg

SEQ ID NO: 5696 - DNA, 46 bp, Artificial Sequence
  Synthesized adaptor oligonucleotide
  misc_feature (34)..(36): n is a, c, g, or t
tgcaggaccagagaattcgaatacatcgccccannngatcgacatg

SEQ ID NO: 5697 - DNA, 46 bp, Artificial Sequence
  Synthesized adaptor oligonucleotide
  misc_feature (34)..(36): n is a, c, g, or t
tgcaggaccagagaattcgaatacatgcattggnnngatcgacatg

SEQ ID NO: 5698 - DNA, 46 bp, Artificial Sequence
  Synthesized adaptor oligonucleotide
  misc_feature (34)..(36): n is a, c, g, or t
tgcaggaccagagaattcgaatacaatcagattnnngatcgacatg

SEQ ID NO: 5699 - DNA, 46 bp, Artificial Sequence
  Synthesized adaptor oligonucleotide
  misc_feature (34)..(36): n is a, c, g, or t
tgcaggaccagagaattcgaatacacttttatgnnngatcgacatg

SEQ ID NO: 5700 - DNA, 46 bp, Artificial Sequence
  Synthesized adaptor oligonucleotide
  misc_feature (34)..(36): n is a, c, g, or t
tgcaggaccagagaattcgaatacaaaagtcggnnngatcgacatg

SEQ ID NO: 5701 - DNA, 46 bp, Artificial Sequence
  Synthesized adaptor oligonucleotide
  misc_feature (34)..(36): n is a, c, g, or t
tgcaggaccagagaattcgaatacaacgagtgannngatcgacatg

SEQ ID NO: 5702 - DNA, 46 bp, Artificial Sequence
  Synthesized adaptor oligonucleotide
  misc_feature (34)..(36): n is a, c, g, or t
tgcaggaccagagaattcgaatacagaaattagnnngatcgacatg

SEQ ID NO: 5703 - DNA, 46 bp, Artificial Sequence
  Synthesized adaptor oligonucleotide
  misc_feature (34)..(36): n is a, c, g, or t
tgcaggaccagagaattcgaatacaattatctcnnngatcgacatg

SEQ ID NO: 5704 - DNA, 46 bp, Artificial Sequence
  Synthesized adaptor oligonucleotide
  misc_feature (34)..(36): n is a, c, g, or t
tgcaggaccagagaattcgaatacagctcggcannngatcgacatg

SEQ ID NO: 5705 - DNA, 46 bp, Artificial Sequence
  Synthesized adaptor oligonucleotide
  misc_feature (34)..(36): n is a, c, g, or t
tgcaggaccagagaattcgaatacagttagaggnnngatcgacatg

SEQ ID NO: 5706 - DNA, 46 bp, Artificial Sequence
  Synthesized adaptor oligonucleotide
  misc_feature (34)..(36): n is a, c, g, or t
tgcaggaccagagaattcgaatacaaccagctannngatcgacatg

SEQ ID NO: 5707 - DNA, 46 bp, Artificial Sequence
  Synthesized adaptor oligonucleotide
  misc_feature (34)..(36): n is a, c, g, or t
tgcaggaccagagaattcgaatacaggagtgcgnnngatcgacatg

SEQ ID NO: 5708 - DNA, 46 bp, Artificial Sequence
  Synthesized adaptor oligonucleotide
  misc_feature (34)..(36): n is a, c, g, or t
tgcaggaccagagaattcgaatacatcgatatannngatcgacatg

SEQ ID NO: 5709 - DNA, 46 bp, Artificial Sequence
  Synthesized adaptor oligonucleotide
  misc_feature (34)..(36): n is a, c, g, or t
tgcaggaccagagaattcgaatacagcgctagcnnntgcatcaggt

SEQ ID NO: 5710 - DNA, 46 bp, Artificial Sequence
  Synthesized adaptor oligonucleotide
  misc_feature (34)..(36): n is a, c, g, or t
tgcaggaccagagaattcgaatacactgattaannntgcatcaggt

SEQ ID NO: 5711 - DNA, 46 bp, Artificial Sequence
  Synthesized adaptor oligonucleotide
  misc_feature (34)..(36): n is a, c, g, or t
tgcaggaccagagaattcgaatacacacttcacnnntgcatcaggt

SEQ ID NO: 5712 - DNA, 46 bp, Artificial Sequence
  Synthesized adaptor oligonucleotide
  misc_feature (34)..(36): n is a, c, g, or t
tgcaggaccagagaattcgaatacataggcgttnnntgcatcaggt

SEQ ID NO: 5713 - DNA, 46 bp, Artificial Sequence
  Synthesized adaptor oligonucleotide
  misc_feature (34)..(36): n is a, c, g, or t
tgcaggaccagagaattcgaatacaatatgtcannntgcatcaggt

SEQ ID NO: 5714 - DNA, 46 bp, Artificial Sequence
  Synthesized adaptor oligonucleotide
  misc_feature (34)..(36): n is a, c, g, or t
tgcaggaccagagaattcgaatacagtcgattgnnntgcatcaggt

SEQ ID NO: 5715 - DNA, 46 bp, Artificial Sequence
  Synthesized adaptor oligonucleotide
  misc_feature (34)..(36): n is a, c, g, or t
tgcaggaccagagaattcgaatacaatagagcgnnntgcatcaggt

SEQ ID NO: 5716 - DNA, 46 bp, Artificial Sequence
  Synthesized adaptor oligonucleotide
  misc_feature (34)..(36): n is a, c, g, or t
tgcaggaccagagaattcgaatacagactaaggnnntgcatcaggt

SEQ ID NO: 5717 - DNA, 46 bp, Artificial Sequence
  Synthesized adaptor oligonucleotide
  misc_feature (34)..(36): n is a, c, g, or t
tgcaggaccagagaattcgaatacacctacctannntgcatcaggt

SEQ ID NO: 5718 - DNA, 46 bp, Artificial Sequence
  Synthesized adaptor oligonucleotide
  misc_feature (34)..(36): n is a, c, g, or t
tgcaggaccagagaattcgaatacataggagacnnntgcatcaggt

SEQ ID NO: 5719 - DNA, 46 bp, Artificial Sequence
  Synthesized adaptor oligonucleotide
  misc_feature (34)..(36): n is a, c, g, or t
tgcaggaccagagaattcgaatacaccgtcattnnntgcatcaggt

SEQ ID NO: 5720 - DNA, 46 bp, Artificial Sequence
  Synthesized adaptor oligonucleotide
  misc_feature (34)..(36): n is a, c, g, or t
tgcaggaccagagaattcgaatacagtgttcagnnntgcatcaggt

SEQ ID NO: 5721 - DNA, 46 bp, Artificial Sequence
  Synthesized adaptor oligonucleotide
  misc_feature (34)..(36): n is a, c, g, or t
tgcaggaccagagaattcgaatacaagcggtttnnntgcatcaggt

SEQ ID NO: 5722 - DNA, 46 bp, Artificial Sequence
  Synthesized adaptor oligonucleotide
  misc_feature (34)..(36): n is a, c, g, or t
tgcaggaccagagaattcgaatacaaactctttnnntgcatcaggt

SEQ ID NO: 5723 - DNA, 46 bp, Artificial Sequence
  Synthesized adaptor oligonucleotide
  misc_feature (34)..(36): n is a, c, g, or t
tgcaggaccagagaattcgaatacataacgtatnnntgcatcaggt

SEQ ID NO: 5724 - DNA, 46 bp, Artificial Sequence
  Synthesized adaptor oligonucleotide
  misc_feature (34)..(36): n is a, c, g, or t
tgcaggaccagagaattcgaatacaaaggactgnnntgcatcaggt

SEQ ID NO: 5725 - DNA, 46 bp, Artificial Sequence
  Synthesized adaptor oligonucleotide
  misc_feature (34)..(36): n is a, c, g, or t
tgcaggaccagagaattcgaatacaaggagaagnnntgcatcaggt

SEQ ID NO: 5726 - DNA, 46 bp, Artificial Sequence
  Synthesized adaptor oligonucleotide
  misc_feature (34)..(36): n is a, c, g, or t
tgcaggaccagagaattcgaatacatcgaacgtnnntgcatcaggt

SEQ ID NO: 5727 - DNA, 46 bp, Artificial Sequence
  Synthesized adaptor oligonucleotide
  misc_feature (34)..(36): n is a, c, g, or t
tgcaggaccagagaattcgaatacacggacattnnntgcatcaggt

SEQ ID NO: 5728 - DNA, 46 bp, Artificial Sequence
  Synthesized adaptor oligonucleotide
  misc_feature (34)..(36): n is a, c, g, or t
tgcaggaccagagaattcgaatacattccgcatnnntgcatcaggt

SEQ ID NO: 5729 - DNA, 46 bp, Artificial Sequence
  Synthesized adaptor oligonucleotide
  misc_feature (34)..(36): n is a, c, g, or t
tgcaggaccagagaattcgaatacacgcggctannntgcatcaggt

SEQ ID NO: 5730 - DNA, 46 bp, Artificial Sequence
  Synthesized adaptor oligonucleotide
  misc_feature (34)..(36): n is a, c, g, or t
tgcaggaccagagaattcgaatacagtttctgcnnntgcatcaggt

SEQ ID NO: 5731 - DNA, 46 bp, Artificial Sequence
  Synthesized adaptor oligonucleotide
  misc_feature (34)..(36): n is a, c, g, or t
tgcaggaccagagaattcgaatacaagacagcannntgcatcaggt

SEQ ID NO: 5732 - DNA, 46 bp, Artificial Sequence
  Synthesized adaptor oligonucleotide
  misc_feature (34)..(36): n is a, c, g, or t
tgcaggaccagagaattcgaatacagaccctccnnntgcatcaggt

SEQ ID NO: 5733 - DNA, 46 bp, Artificial Sequence
  Synthesized adaptor oligonucleotide
  misc_feature (34)..(36): n is a, c, g, or t
tgcaggaccagagaattcgaatacatactcgctnnntgcatcaggt

SEQ ID NO: 5734 - DNA, 46 bp, Artificial Sequence
  Synthesized adaptor oligonucleotide
  misc_feature (34)..(36): n is a, c, g, or t
tgcaggaccagagaattcgaatacattcgtattnnntgcatcaggt

SEQ ID NO: 5735 - DNA, 46 bp, Artificial Sequence
  Synthesized adaptor oligonucleotide
  misc_feature (34)..(36): n is a, c, g, or t
tgcaggaccagagaattcgaatacatacttaagnnntgcatcaggt

SEQ ID NO: 5736 - DNA, 46 bp, Artificial Sequence
  Synthesized adaptor oligonucleotide
  misc_feature (34)..(36): n is a, c, g, or t
tgcaggaccagagaattcgaatacagactacgtnnntgcatcaggt

SEQ ID NO: 5737 - DNA, 46 bp, Artificial Sequence
  Synthesized adaptor oligonucleotide
  misc_feature (34)..(36): n is a, c, g, or t
tgcaggaccagagaattcgaatacaacgagtctnnntgcatcaggt

SEQ ID NO: 5738 - DNA, 46 bp, Artificial Sequence
  Synthesized adaptor oligonucleotide
  misc_feature (34)..(36): n is a, c, g, or t
tgcaggaccagagaattcgaatacagatcgttgnnntgcatcaggt

SEQ ID NO: 5739 - DNA, 46 bp, Artificial Sequence
  Synthesized adaptor oligonucleotide
  misc_feature (34)..(36): n is a, c, g, or t
tgcaggaccagagaattcgaatacagatggacannntgcatcaggt

SEQ ID NO: 5740 - DNA, 46 bp, Artificial Sequence
  Synthesized adaptor oligonucleotide
  misc_feature (34)..(36): n is a, c, g, or t
tgcaggaccagagaattcgaatacatcgtagtgnnntgcatcaggt

SEQ ID NO: 5741 - DNA, 46 bp, Artificial Sequence
  Synthesized adaptor oligonucleotide
  misc_feature (34)..(36): n is a, c, g, or t
tgcaggaccagagaattcgaatacaccacatctnnntgcatcaggt

SEQ ID NO: 5742 - DNA, 46 bp, Artificial Sequence
  Synthesized adaptor oligonucleotide
  misc_feature (34)..(36): n is a, c, g, or t
tgcaggaccagagaattcgaatacagtgctacannntgcatcaggt

SEQ ID NO: 5743 - DNA, 46 bp, Artificial Sequence
  Synthesized adaptor oligonucleotide
  misc_feature (34)..(36): n is a, c, g, or t
tgcaggaccagagaattcgaatacattcttcaannntgcatcaggt

SEQ ID NO: 5744 - DNA, 46 bp, Artificial Sequence
  Synthesized adaptor oligonucleotide
  misc_feature (34)..(36): n is a, c, g, or t
tgcaggaccagagaattcgaatacattacagtannntgcatcaggt

SEQ ID NO: 5745 - DNA, 46 bp, Artificial Sequence
  Synthesized adaptor oligonucleotide
  misc_feature (34)..(36): n is a, c, g, or t
tgcaggaccagagaattcgaatacaagacgcggnnntgcatcaggt

SEQ ID NO: 5746 - DNA, 46 bp, Artificial Sequence
  Synthesized adaptor oligonucleotide
  misc_feature (34)..(36): n is a, c, g, or t
tgcaggaccagagaattcgaatacaggagctccnnntgcatcaggt

SEQ ID NO: 5747 - DNA, 46 bp, Artificial Sequence
  Synthesized adaptor oligonucleotide
  misc_feature (34)..(36): n is a, c, g, or t
tgcaggaccagagaattcgaatacaattaaccannntgcatcaggt

SEQ ID NO: 5748 - DNA, 46 bp, Artificial Sequence
  Synthesized adaptor oligonucleotide
  misc_feature (34)..(36): n is a, c, g, or t
tgcaggaccagagaattcgaatacaatcgagctnnntgcatcaggt

SEQ ID NO: 5749 - DNA, 46 bp, Artificial Sequence
  Synthesized adaptor oligonucleotide
  misc_feature (34)..(36): n is a, c, g, or t
tgcaggaccagagaattcgaatacaggaaacgtnnntgcatcaggt

SEQ ID NO: 5750 - DNA, 46 bp, Artificial Sequence
  Synthesized adaptor oligonucleotide
  misc_feature (34)..(36): n is a, c, g, or t
tgcaggaccagagaattcgaatacatgaagagcnnntgcatcaggt

SEQ ID NO: 5751 - DNA, 46 bp, Artificial Sequence
  Synthesized adaptor oligonucleotide
  misc_feature (34)..(36): n is a, c, g, or t
tgcaggaccagagaattcgaatacaatccggatnnntgcatcaggt

SEQ ID NO: 5752 - DNA, 46 bp, Artificial Sequence
  Synthesized adaptor oligonucleotide
  misc_feature (34)..(36): n is a, c, g, or t
tgcaggaccagagaattcgaatacagttgtctcnnntgcatcaggt

SEQ ID NO: 5753 - DNA, 46 bp, Artificial Sequence
  Synthesized adaptor oligonucleotide
  misc_feature (34)..(36): n is a, c, g, or t
tgcaggaccagagaattcgaatacatggataggnnntgcatcaggt

SEQ ID NO: 5754 - DNA, 46 bp, Artificial Sequence
  Synthesized adaptor oligonucleotide
  misc_feature (34)..(36): n is a, c, g, or t
tgcaggaccagagaattcgaatacaaaaccaggnnntgcatcaggt

SEQ ID NO: 5755 - DNA, 46 bp, Artificial Sequence
  Synthesized adaptor oligonucleotide
  misc_feature (34)..(36): n is a, c, g, or t
tgcaggaccagagaattcgaatacacggcgactnnntgcatcaggt

SEQ ID NO: 5756 - DNA, 46 bp, Artificial Sequence
  Synthesized adaptor oligonucleotide
  misc_feature (34)..(36): n is a, c, g, or t
tgcaggaccagagaattcgaatacattatcgccnnntgcatcaggt

SEQ ID NO: 5757 - DNA, 46 bp, Artificial Sequence
  Synthesized adaptor oligonucleotide
  misc_feature (34)..(36): n is a, c, g, or t
tgcaggaccagagaattcgaatacaagccacatnnntgcatcaggt

SEQ ID NO: 5758 - DNA, 46 bp, Artificial Sequence
  Synthesized adaptor oligonucleotide
  misc_feature (34)..(36): n is a, c, g, or t
tgcaggaccagagaattcgaatacatgctcatcnnntgcatcaggt

SEQ ID NO: 5759 - DNA, 46 bp, Artificial Sequence
  Synthesized adaptor oligonucleotide
  misc_feature (34)..(36): n is a, c, g, or t
tgcaggaccagagaattcgaatacagctggaggnnntgcatcaggt

SEQ ID NO: 5760 - DNA, 46 bp, Artificial Sequence
  Synthesized adaptor oligonucleotide
  misc_feature (34)..(36): n is a, c, g, or t
tgcaggaccagagaattcgaatacaaaagatgtnnntgcatcaggt

SEQ ID NO: 5761 - DNA, 46 bp, Artificial Sequence
  Synthesized adaptor oligonucleotide
  misc_feature (34)..(36): n is a, c, g, or t
tgcaggaccagagaattcgaatacatcagaaaannntgcatcaggt

SEQ ID NO: 5762 - DNA, 46 bp, Artificial Sequence
  Synthesized adaptor oligonucleotide
  misc_feature (34)..(36): n is a, c, g, or t
tgcaggaccagagaattcgaatacagtcctgaannntgcatcaggt

SEQ ID NO: 5763 - DNA, 46 bp, Artificial Sequence
  Synthesized adaptor oligonucleotide
  misc_feature (34)..(36): n is a, c, g, or t
tgcaggaccagagaattcgaatacagctaggccnnntgcatcaggt

SEQ ID NO: 5764 - DNA, 46 bp, Artificial Sequence
  Synthesized adaptor oligonucleotide
  misc_feature (34)..(36): n is a, c, g, or t
tgcaggaccagagaattcgaatacactcctgtannntgcatcaggt

SEQ ID NO: 5765 - DNA, 46 bp, Artificial Sequence
  Synthesized adaptor oligonucleotide
  misc_feature (34)..(36): n is a, c, g, or t
tgcaggaccagagaattcgaatacattgatcaannntgcatcaggt

SEQ ID NO: 5766 - DNA, 46 bp, Artificial Sequence
  Synthesized adaptor oligonucleotide
  misc_feature (34)..(36): n is a, c, g, or t
tgcaggaccagagaattcgaatacactgttcgtnnntgcatcaggt

SEQ ID NO: 5767 - DNA, 46 bp, Artificial Sequence
  Synthesized adaptor oligonucleotide
  misc_feature (34)..(36): n is a, c, g, or t
tgcaggaccagagaattcgaatacatcttatcannntgcatcaggt

SEQ ID NO: 5768 - DNA, 46 bp, Artificial Sequence
  Synthesized adaptor oligonucleotide
  misc_feature (34)..(36): n is a, c, g, or t
tgcaggaccagagaattcgaatacatactggcannntgcatcaggt

SEQ ID NO: 5769 - DNA, 46 bp, Artificial Sequence
  Synthesized adaptor oligonucleotide
  misc_feature (34)..(36): n is a, c, g, or t
tgcaggaccagagaattcgaatacacgcgacgtnnnacgtatgcca

SEQ ID NO: 5770 - DNA, 46 bp, Artificial Sequence
  Synthesized adaptor oligonucleotide
  misc_feature (34)..(36): n is a, c, g, or t
tgcaggaccagagaattcgaatacaccgatcaannnacgtatgcca

SEQ ID NO: 5771 - DNA, 46 bp, Artificial Sequence
  Synthesized adaptor oligonucleotide
  misc_feature (34)..(36): n is a, c, g, or t
tgcaggaccagagaattcgaatacaggcaatctnnnacgtatgcca

SEQ ID NO: 5772 - DNA, 46 bp, Artificial Sequence
  Synthesized adaptor oligonucleotide
  misc_feature (34)..(36): n is a, c, g, or t
tgcaggaccagagaattcgaatacactaggagannnacgtatgcca

SEQ ID NO: 5773 - DNA, 46 bp, Artificial Sequence
  Synthesized adaptor oligonucleotide
  misc_feature (34)..(36): n is a, c, g, or t
tgcaggaccagagaattcgaatacattgataacnnnacgtatgcca

SEQ ID NO: 5774 - DNA, 46 bp, Artificial Sequence
  Synthesized adaptor oligonucleotide
  misc_feature (34)..(36): n is a, c, g, or t
tgcaggaccagagaattcgaatacagagtactcnnnacgtatgcca

SEQ ID NO: 5775 - DNA, 46 bp, Artificial Sequence
  Synthesized adaptor oligonucleotide
  misc_feature (34)..(36): n is a, c, g, or t
tgcaggaccagagaattcgaatacaatgccgcgnnnacgtatgcca

SEQ ID NO: 5776 - DNA, 46 bp, Artificial Sequence
  Synthesized adaptor oligonucleotide
  misc_feature (34)..(36): n is a, c, g, or t
tgcaggaccagagaattcgaatacaaaatagcannnacgtatgcca

SEQ ID NO: 5777 - DNA, 46 bp, Artificial Sequence
  Synthesized adaptor oligonucleotide
  misc_feature (34)..(36): n is a, c, g, or t
tgcaggaccagagaattcgaatacaatcagaccnnnacgtatgcca

SEQ ID NO: 5778 - DNA, 46 bp, Artificial Sequence
  Synthesized adaptor oligonucleotide
  misc_feature (34)..(36): n is a, c, g, or t
tgcaggaccagagaattcgaatacaggtgcgtcnnnacgtatgcca

SEQ ID NO: 5779 - DNA, 46 bp, Artificial Sequence
  Synthesized adaptor oligonucleotide
  misc_feature (34)..(36): n is a, c, g, or t
tgcaggaccagagaattcgaatacatctttcccnnnacgtatgcca

SEQ ID NO: 5780 - DNA, 46 bp, Artificial Sequence
  Synthesized adaptor oligonucleotide
  misc_feature (34)..(36): n is a, c, g, or t
tgcaggaccagagaattcgaatacaaaattccannnacgtatgcca

SEQ ID NO: 5781 - DNA, 46 bp, Artificial Sequence
  Synthesized adaptor oligonucleotide
  misc_feature (34)..(36): n is a, c, g, or t
tgcaggaccagagaattcgaatacaaatgtgccnnnacgtatgcca

SEQ ID NO: 5782 - DNA, 46 bp, Artificial Sequence
  Synthesized adaptor oligonucleotide
  misc_feature (34)..(36): n is a, c, g, or t
tgcaggaccagagaattcgaatacacacatgacnnnacgtatgcca

SEQ ID NO: 5783 - DNA, 46 bp, Artificial Sequence
  Synthesized adaptor oligonucleotide
  misc_feature (34)..(36): n is a, c, g, or t
tgcaggaccagagaattcgaatacagacctggcnnnacgtatgcca

SEQ ID NO: 5784 - DNA, 46 bp, Artificial Sequence
  Synthesized adaptor oligonucleotide
  misc_feature (34)..(36): n is a, c, g, or t
tgcaggaccagagaattcgaatacaccaaaattnnnacgtatgcca

SEQ ID NO: 5785 - DNA, 46 bp, Artificial Sequence
  Synthesized adaptor oligonucleotide
  misc_feature (34)..(36): n is a, c, g, or t
tgcaggaccagagaattcgaatacaattgtcccnnnacgtatgcca

SEQ ID NO: 5786 - DNA, 46 bp, Artificial Sequence
  Synthesized adaptor oligonucleotide
  misc_feature (34)..(36): n is a, c, g, or t
tgcaggaccagagaattcgaatacacgtcgacgnnnacgtatgcca

SEQ ID NO: 5787 - DNA, 46 bp, Artificial Sequence
  Synthesized adaptor oligonucleotide
  misc_feature (34)..(36): n is a, c, g, or t
tgcaggaccagagaattcgaatacacccgctcannnacgtatgcca

SEQ ID NO: 5788 - DNA, 46 bp, Artificial Sequence
  Synthesized adaptor oligonucleotide
  misc_feature (34)..(36): n is a, c, g, or t
tgcaggaccagagaattcgaatacaatggactcnnnacgtatgcca

SEQ ID NO: 5789 - DNA, 46 bp, Artificial Sequence
  Synthesized adaptor oligonucleotide
  misc_feature (34)..(36): n is a, c, g, or t
tgcaggaccagagaattcgaatacattgtaacannnacgtatgcca

SEQ ID NO: 5790 - DNA, 46 bp, Artificial Sequence
  Synthesized adaptor oligonucleotide
  misc_feature (34)..(36): n is a, c, g, or t
tgcaggaccagagaattcgaatacagtttacttnnnacgtatgcca

SEQ ID NO: 5791 - DNA, 46 bp, Artificial Sequence
  Synthesized adaptor oligonucleotide
  misc_feature (34)..(36): n is a, c, g, or t
tgcaggaccagagaattcgaatacatggataaannnacgtatgcca

SEQ ID NO: 5792 - DNA, 46 bp, Artificial Sequence
  Synthesized adaptor oligonucleotide
  misc_feature (34)..(36): n is a, c, g, or t
tgcaggaccagagaattcgaatacaatccttcgnnnacgtatgcca

SEQ ID NO: 5793 - DNA, 46 bp, Artificial Sequence
  Synthesized adaptor oligonucleotide
  misc_feature (34)..(36): n is a, c, g, or t
tgcaggaccagagaattcgaatacacgcatacannnacgtatgcca

SEQ ID NO: 5794 - DNA, 46 bp, Artificial Sequence
  Synthesized adaptor oligonucleotide
  misc_feature (34)..(36): n is a, c, g, or t
tgcaggaccagagaattcgaatacaacaccgatnnnacgtatgcca

SEQ ID NO: 5795 - DNA, 46 bp, Artificial Sequence
  Synthesized adaptor oligonucleotide
  misc_feature (34)..(36): n is a, c, g, or t
tgcaggaccagagaattcgaatacaattgctccnnnacgtatgcca

SEQ ID NO: 5796 - DNA, 46 bp, Artificial Sequence
  Synthesized adaptor oligonucleotide
  misc_feature (34)..(36): n is a, c, g, or t
tgcaggaccagagaattcgaatacaatcttctannnacgtatgcca

SEQ ID NO: 5797 - DNA, 46 bp, Artificial Sequence
  Synthesized adaptor oligonucleotide
  misc_feature (34)..(36): n is a, c, g, or t
tgcaggaccagagaattcgaatacatcgaaattnnnacgtatgcca

SEQ ID NO: 5798 - DNA, 46 bp, Artificial Sequence
  Synthesized adaptor oligonucleotide
  misc_feature (34)..(36): n is a, c, g, or t
tgcaggaccagagaattcgaatacacaagtcacnnnacgtatgcca

SEQ ID NO: 5799 - DNA, 46 bp, Artificial Sequence
  Synthesized adaptor oligonucleotide
  misc_feature (34)..(36): n is a, c, g, or t
tgcaggaccagagaattcgaatacatgacccggnnnacgtatgcca

SEQ ID NO: 5800 - DNA, 46 bp, Artificial Sequence
  Synthesized adaptor oligonucleotide
  misc_feature (34)..(36): n is a, c, g, or t
tgcaggaccagagaattcgaatacaagctgccgnnnacgtatgcca

SEQ ID NO: 5801 - DNA, 46 bp, Artificial Sequence
  Synthesized adaptor oligonucleotide
  misc_feature (34)..(36): n is a, c, g, or t
tgcaggaccagagaattcgaatacatcactcgtnnnacgtatgcca

SEQ ID NO: 5802 - DNA, 46 bp, Artificial Sequence
  Synthesized adaptor oligonucleotide
  misc_feature (34)..(36): n is a, c, g, or t
tgcaggaccagagaattcgaatacagttaccgannnacgtatgcca

SEQ ID NO: 5803 - DNA, 46 bp, Artificial Sequence
  Synthesized adaptor oligonucleotide
  misc_feature (34)..(36): n is a, c, g, or t
tgcaggaccagagaattcgaatacacttagatannnacgtatgcca

SEQ ID NO: 5804 - DNA, 46 bp, Artificial Sequence
  Synthesized adaptor oligonucleotide
  misc_feature (34)..(36): n is a, c, g, or t
tgcaggaccagagaattcgaatacaaggctagannnacgtatgcca

SEQ ID NO: 5805 - DNA, 46 bp, Artificial Sequence
  Synthesized adaptor oligonucleotide
  misc_feature (34)..(36): n is a, c, g, or t
tgcaggaccagagaattcgaatacatcacaggtnnnacgtatgcca

SEQ ID NO: 5806 - DNA, 46 bp, Artificial Sequence
  Synthesized adaptor oligonucleotide
  misc_feature (34)..(36): n is a, c, g, or t
tgcaggaccagagaattcgaatacagatatttgnnnacgtatgcca

SEQ ID NO: 5807 - DNA, 46 bp, Artificial Sequence
  Synthesized adaptor oligonucleotide
  misc_feature (34)..(36): n is a, c, g, or t
tgcaggaccagagaattcgaatacattgtgtttnnnacgtatgcca

SEQ ID NO: 5808 - DNA, 46 bp, Artificial Sequence
  Synthesized adaptor oligonucleotide
  misc_feature (34)..(36): n is a, c, g, or t
tgcaggaccagagaattcgaatacagaaaaaagnnnacgtatgcca

SEQ ID NO: 5809 - DNA, 46 bp, Artificial Sequence
  Synthesized adaptor oligonucleotide
  misc_feature (34)..(36): n is a, c, g, or t
tgcaggaccagagaattcgaatacaggcatgttnnnacgtatgcca

SEQ ID NO: 5810 - DNA, 46 bp, Artificial Sequence
  Synthesized adaptor oligonucleotide
  misc_feature (34)..(36): n is a, c, g, or t
tgcaggaccagagaattcgaatacaggcttttcnnnacgtatgcca

SEQ ID NO: 5811 - DNA, 46 bp, Artificial Sequence
  Synthesized adaptor oligonucleotide
  misc_feature (34)..(36): n is a, c, g, or t
tgcaggaccagagaattcgaatacaactaatacnnnacgtatgcca

SEQ ID NO: 5812 - DNA, 46 bp, Artificial Sequence
  Synthesized adaptor oligonucleotide
  misc_feature (34)..(36): n is a, c, g, or t
tgcaggaccagagaattcgaatacagtagcccgnnnacgtatgcca

SEQ ID NO: 5813 - DNA, 46 bp, Artificial Sequence
  Synthesized adaptor oligonucleotide
  misc_feature (34)..(36): n is a, c, g, or t
tgcaggaccagagaattcgaatacataacgtcgnnnacgtatgcca

SEQ ID NO: 5814 - DNA, 46 bp, Artificial Sequence
  Synthesized adaptor oligonucleotide
  misc_feature (34)..(36): n is a, c, g, or t
tgcaggaccagagaattcgaatacatttcaagannnacgtatgcca

SEQ ID NO: 5815 - DNA, 46 bp, Artificial Sequence
  Synthesized adaptor oligonucleotide
  misc_feature (34)..(36): n is a, c, g, or t
tgcaggaccagagaattcgaatacacacaagagnnnacgtatgcca

SEQ ID NO: 5816 - DNA, 46 bp, Artificial Sequence
  Synthesized adaptor oligonucleotide
  misc_feature (34)..(36): n is a, c, g, or t
tgcaggaccagagaattcgaatacacccgtttannnacgtatgcca

SEQ ID NO: 5817 - DNA, 46 bp, Artificial Sequence
  Synthesized adaptor oligonucleotide
  misc_feature (34)..(36): n is a, c, g, or t
tgcaggaccagagaattcgaatacagttaagaannnacgtatgcca

SEQ ID NO: 5818 - DNA, 46 bp, Artificial Sequence
  Synthesized adaptor oligonucleotide
  misc_feature (34)..(36): n is a, c, g, or t
tgcaggaccagagaattcgaatacagaacctacnnnacgtatgcca

SEQ ID NO: 5819 - DNA, 46 bp, Artificial Sequence
  Synthesized adaptor oligonucleotide
  misc_feature (34)..(36): n is a, c, g, or t
tgcaggaccagagaattcgaatacaagcgacttnnnacgtatgcca

SEQ ID NO: 5820 - DNA, 46 bp, Artificial Sequence
  Synthesized adaptor oligonucleotide
  misc_feature (34)..(36): n is a, c, g, or t
tgcaggaccagagaattcgaatacacgcactaannnacgtatgcca

SEQ ID NO: 5821 - DNA, 46 bp, Artificial Sequence
  Synthesized adaptor oligonucleotide
  misc_feature (34)..(36): n is a, c, g, or t
tgcaggaccagagaattcgaatacaggtgttcannnacgtatgcca

SEQ ID NO: 5822 - DNA, 46 bp, Artificial Sequence
  Synthesized adaptor oligonucleotide
  misc_feature (34)..(36): n is a, c, g, or t
tgcaggaccagagaattcgaatacacttttcaannnacgtatgcca

SEQ ID NO: 5823 - DNA, 46 bp, Artificial Sequence
  Synthesized adaptor oligonucleotide
  misc_feature (34)..(36): n is a, c, g, or t
tgcaggaccagagaattcgaatacagattcatannnacgtatgcca

SEQ ID NO: 5824 - DNA, 46 bp, Artificial Sequence
  Synthesized adaptor oligonucleotide
  misc_feature (34)..(36): n is a, c, g, or t
tgcaggaccagagaattcgaatacattgacgacnnnacgtatgcca

SEQ ID NO: 5825 - DNA, 46 bp, Artificial Sequence
  Synthesized adaptor oligonucleotide
  misc_feature (34)..(36): n is a, c, g, or t
tgcaggaccagagaattcgaatacaccttgtacnnnacgtatgcca

SEQ ID NO: 5826 - DNA, 46 bp, Artificial Sequence
  Synthesized adaptor oligonucleotide
  misc_feature (34)..(36): n is a, c, g, or t
tgcaggaccagagaattcgaatacaggtgcggannnacgtatgcca

SEQ ID NO: 5827 - DNA, 46 bp, Artificial Sequence
  Synthesized adaptor oligonucleotide
  misc_feature (34)..(36): n is a, c, g, or t
tgcaggaccagagaattcgaatacatcatgaatnnnacgtatgcca

SEQ ID NO: 5828 - DNA, 46 bp, Artificial Sequence
  Synthesized adaptor oligonucleotide
  misc_feature (34)..(36): n is a, c, g, or t
tgcaggaccagagaattcgaatacagcgaaagtnnnacgtatgcca

SEQ ID NO: 5829 - DNA, 46 bp, Artificial Sequence
  Synthesized adaptor oligonucleotide
  misc_feature (34)..(36): n is a, c, g, or t
tgcaggaccagagaattcgaatacaaaaataatnnnctagcgttac

SEQ ID NO: 5830 - DNA, 46 bp, Artificial Sequence
  Synthesized adaptor oligonucleotide
  misc_feature (34)..(36): n is a, c, g, or t
tgcaggaccagagaattcgaatacattcgtgtcnnnctagcgttac

SEQ ID NO: 5831 - DNA, 46 bp, Artificial Sequence
  Synthesized adaptor oligonucleotide
  misc_feature (34)..(36): n is a, c, g, or t
tgcaggaccagagaattcgaatacatcgtcttgnnnctagcgttac

SEQ ID NO: 5832 - DNA, 46 bp, Artificial Sequence
  Synthesized adaptor oligonucleotide
  misc_feature (34)..(36): n is a, c, g, or t
tgcaggaccagagaattcgaatacagactgtgtnnnctagcgttac

SEQ ID NO: 5833 - DNA, 46 bp, Artificial Sequence
  Synthesized adaptor oligonucleotide
  misc_feature (34)..(36): n is a, c, g, or t
tgcaggaccagagaattcgaatacaccattggannnctagcgttac

SEQ ID NO: 5834 - DNA, 46 bp, Artificial Sequence
  Synthesized adaptor oligonucleotide
  misc_feature (34)..(36): n is a, c, g, or t
tgcaggaccagagaattcgaatacacacagcgcnnnctagcgttac

SEQ ID NO: 5835 - DNA, 46 bp, Artificial Sequence
  Synthesized adaptor oligonucleotide
  misc_feature (34)..(36): n is a, c, g, or t
tgcaggaccagagaattcgaatacaaccccgtcnnnctagcgttac

SEQ ID NO: 5836 - DNA, 46 bp, Artificial Sequence
  Synthesized adaptor oligonucleotide
  misc_feature (34)..(36): n is a, c, g, or t
tgcaggaccagagaattcgaatacatcaccttgnnnctagcgttac

SEQ ID NO: 5837 - DNA, 46 bp, Artificial Sequence
  Synthesized adaptor oligonucleotide
  misc_feature (34)..(36): n is a, c, g, or t
tgcaggaccagagaattcgaatacaagtaccacnnnctagcgttac

SEQ ID NO: 5838 - DNA, 46 bp, Artificial Sequence
  Synthesized adaptor oligonucleotide
  misc_feature (34)..(36): n is a, c, g, or t
tgcaggaccagagaattcgaatacaacaaatgannnctagcgttac

SEQ ID NO: 5839 - DNA, 46 bp, Artificial Sequence
  Synthesized adaptor oligonucleotide
  misc_feature (34)..(36): n is a, c, g, or t
tgcaggaccagagaattcgaatacaattgttgannnctagcgttac

SEQ ID NO: 5840 - DNA, 46 bp, Artificial Sequence
  Synthesized adaptor oligonucleotide
  misc_feature (34)..(36): n is a, c, g, or t
tgcaggaccagagaattcgaatacaacggaaacnnnctagcgttac

SEQ ID NO: 5841 - DNA, 46 bp, Artificial Sequence
  Synthesized adaptor oligonucleotide
  misc_feature (34)..(36): n is a, c, g, or t
tgcaggaccagagaattcgaatacagagaacgtnnnctagcgttac

SEQ ID NO: 5842 - DNA, 46 bp, Artificial Sequence
  Synthesized adaptor oligonucleotide
  misc_feature (34)..(36): n is a, c, g, or t
tgcaggaccagagaattcgaatacataccatggnnnctagcgttac

SEQ ID NO: 5843 - DNA, 46 bp, Artificial Sequence
  Synthesized adaptor oligonucleotide
  misc_feature (34)..(36): n is a, c, g, or t
tgcaggaccagagaattcgaatacacaaaacggnnnctagcgttac

SEQ ID NO: 5844 - DNA, 46 bp, Artificial Sequence
  Synthesized adaptor oligonucleotide
  misc_feature (34)..(36): n is a, c, g, or t
tgcaggaccagagaattcgaatacatagtgaggnnnctagcgttac

SEQ ID NO: 5845 - DNA, 46 bp, Artificial Sequence
  Synthesized adaptor oligonucleotide
  misc_feature (34)..(36): n is a, c, g, or t
tgcaggaccagagaattcgaatacacgtgatacnnnctagcgttac

SEQ ID NO: 5846 - DNA, 46 bp, Artificial Sequence
  Synthesized adaptor oligonucleotide
  misc_feature (34)..(36): n is a, c, g, or t
tgcaggaccagagaattcgaatacagtgcccctnnnctagcgttac

SEQ ID NO: 5847 - DNA, 46 bp, Artificial Sequence
  Synthesized adaptor oligonucleotide
  misc_feature (34)..(36): n is a, c, g, or t
tgcaggaccagagaattcgaatacaggacagtannnctagcgttac

SEQ ID NO: 5848 - DNA, 46 bp, Artificial Sequence
  Synthesized adaptor oligonucleotide
  misc_feature (34)..(36): n is a, c, g, or t
tgcaggaccagagaattcgaatacactagtatannnctagcgttac

SEQ ID NO: 5849 - DNA, 46 bp, Artificial Sequence
  Synthesized adaptor oligonucleotide
  misc_feature (34)..(36): n is a, c, g, or t
tgcaggaccagagaattcgaatacagaaccttgnnnctagcgttac

SEQ ID NO: 5850 - DNA, 46 bp, Artificial Sequence
  Synthesized adaptor oligonucleotide
  misc_feature (34)..(36): n is a, c, g, or t
tgcaggaccagagaattcgaatacactgtttatnnnctagcgttac

SEQ ID NO: 5851 - DNA, 46 bp, Artificial Sequence
  Synthesized adaptor oligonucleotide
  misc_feature (34)..(36): n is a, c, g, or t
tgcaggaccagagaattcgaatacaaataggatnnnctagcgttac

SEQ ID NO: 5852 - DNA, 46 bp, Artificial Sequence
  Synthesized adaptor oligonucleotide
  misc_feature (34)..(36): n is a, c, g, or t
tgcaggaccagagaattcgaatacacgtcaagtnnnctagcgttac

SEQ ID NO: 5853 - DNA, 46 bp, Artificial Sequence
  Synthesized adaptor oligonucleotide
  misc_feature (34)..(36): n is a, c, g, or t
tgcaggaccagagaattcgaatacagctgtttcnnnctagcgttac

SEQ ID NO: 5854 - DNA, 46 bp, Artificial Sequence
  Synthesized adaptor oligonucleotide
  misc_feature (34)..(36): n is a, c, g, or t
tgcaggaccagagaattcgaatacaaccgtgcgnnnctagcgttac

SEQ ID NO: 5855 - DNA, 46 bp, Artificial Sequence
  Synthesized adaptor oligonucleotide
  misc_feature (34)..(36): n is a, c, g, or t
tgcaggaccagagaattcgaatacacagctgcgnnnctagcgttac

SEQ ID NO: 5856 - DNA, 46 bp, Artificial Sequence
  Synthesized adaptor oligonucleotide
  misc_feature (34)..(36): n is a, c, g, or t
tgcaggaccagagaattcgaatacatccttacgnnnctagcgttac

SEQ ID NO: 5857 - DNA, 46 bp, Artificial Sequence
  Synthesized adaptor oligonucleotide
  misc_feature (34)..(36): n is a, c, g, or t
tgcaggaccagagaattcgaatacaaacgaagcnnnctagcgttac

SEQ ID NO: 5858 - DNA, 46 bp, Artificial Sequence
  Synthesized adaptor oligonucleotide
  misc_feature (34)..(36): n is a, c, g, or t
tgcaggaccagagaattcgaatacagaagttttnnnctagcgttac

SEQ ID NO: 5859 - DNA, 46 bp, Artificial Sequence
  Synthesized adaptor oligonucleotide
  misc_feature (34)..(36): n is a, c, g, or t
tgcaggaccagagaattcgaatacagccgttaannnctagcgttac

SEQ ID NO: 5860 - DNA, 46 bp, Artificial Sequence
  Synthesized adaptor oligonucleotide
  misc_feature (34)..(36): n is a, c, g, or t
tgcaggaccagagaattcgaatacatgtgccaannnctagcgttac

SEQ ID NO: 5861 - DNA, 46 bp, Artificial Sequence
  Synthesized adaptor oligonucleotide
  misc_feature (34)..(36): n is a, c, g, or t
tgcaggaccagagaattcgaatacagcaaaacgnnnctagcgttac

SEQ ID NO: 5862 - DNA, 46 bp, Artificial Sequence
  Synthesized adaptor oligonucleotide
  misc_feature (34)..(36): n is a, c, g, or t
tgcaggaccagagaattcgaatacacgtaagagnnnctagcgttac

SEQ ID NO: 5863 - DNA, 46 bp, Artificial Sequence
  Synthesized adaptor oligonucleotide
  misc_feature (34)..(36): n is a, c, g, or t
tgcaggaccagagaattcgaatacatgacgtcannnctagcgttac

SEQ ID NO: 5864 - DNA, 46 bp, Artificial Sequence
  Synthesized adaptor oligonucleotide
  misc_feature (34)..(36): n is a, c, g, or t
tgcaggaccagagaattcgaatacactccctaannnctagcgttac

SEQ ID NO: 5865 - DNA, 46 bp, Artificial Sequence
  Synthesized adaptor oligonucleotide
  misc_feature (34)..(36): n is a, c, g, or t
tgcaggaccagagaattcgaatacatattcagannnctagcgttac

SEQ ID NO: 5866 - DNA, 46 bp, Artificial Sequence
  Synthesized adaptor oligonucleotide
  misc_feature (34)..(36): n is a, c, g, or t
tgcaggaccagagaattcgaatacactagcaacnnnctagcgttac

SEQ ID NO: 5867 - DNA, 46 bp, Artificial Sequence
  Synthesized adaptor oligonucleotide
  misc_feature (34)..(36): n is a, c, g, or t
tgcaggaccagagaattcgaatacagaatgcctnnnctagcgttac

SEQ ID NO: 5868 - DNA, 46 bp, Artificial Sequence
  Synthesized adaptor oligonucleotide
  misc_feature (34)..(36): n is a, c, g, or t
tgcaggaccagagaattcgaatacagacttctcnnnctagcgttac

SEQ ID NO: 5869 - DNA, 46 bp, Artificial Sequence
  Synthesized adaptor oligonucleotide
  misc_feature (34)..(36): n is a, c, g, or t
tgcaggaccagagaattcgaatacataattagcnnnctagcgttac

SEQ ID NO: 5870 - DNA, 46 bp, Artificial Sequence
  Synthesized adaptor oligonucleotide
  misc_feature (34)..(36): n is a, c, g, or t
tgcaggaccagagaattcgaatacacgtgtggcnnnctagcgttac

SEQ ID NO: 5871 - DNA, 46 bp, Artificial Sequence
  Synthesized adaptor oligonucleotide
  misc_feature (34)..(36): n is a, c, g, or t
tgcaggaccagagaattcgaatacagactcgatnnnctagcgttac

SEQ ID NO: 5872 - DNA, 46 bp, Artificial Sequence
  Synthesized adaptor oligonucleotide
  misc_feature (34)..(36): n is a, c, g, or t
tgcaggaccagagaattcgaatacagcgatcgcnnnctagcgttac

SEQ ID NO: 5873 - DNA, 46 bp, Artificial Sequence
  Synthesized adaptor oligonucleotide
  misc_feature (34)..(36): n is a, c, g, or t
tgcaggaccagagaattcgaatacaactctaccnnnctagcgttac

SEQ ID NO: 5874 - DNA, 46 bp, Artificial Sequence
  Synthesized adaptor oligonucleotide
  misc_feature (34)..(36): n is a, c, g, or t
tgcaggaccagagaattcgaatacaggaaggccnnnctagcgttac

SEQ ID NO: 5875 - DNA, 46 bp, Artificial Sequence
  Synthesized adaptor oligonucleotide
  misc_feature (34)..(36): n is a, c, g, or t
tgcaggaccagagaattcgaatacacatattagnnnctagcgttac

SEQ ID NO: 5876 - DNA, 46 bp, Artificial Sequence
  Synthesized adaptor oligonucleotide
  misc_feature (34)..(36): n is a, c, g, or t
tgcaggaccagagaattcgaatacacggtgaccnnnctagcgttac

SEQ ID NO: 5877 - DNA, 46 bp, Artificial Sequence
  Synthesized adaptor oligonucleotide
  misc_feature (34)..(36): n is a, c, g, or t
tgcaggaccagagaattcgaatacagtgcatgtnnnctagcgttac

SEQ ID NO: 5878 - DNA, 46 bp, Artificial Sequence
  Synthesized adaptor oligonucleotide
  misc_feature (34)..(36): n is a, c, g, or t
tgcaggaccagagaattcgaatacataagtgttnnnctagcgttac

SEQ ID NO: 5879 - DNA, 46 bp, Artificial Sequence
  Synthesized adaptor oligonucleotide
  misc_feature (34)..(36): n is a, c, g, or t
tgcaggaccagagaattcgaatacaaccttattnnnctagcgttac

SEQ ID NO: 5880 - DNA, 46 bp, Artificial Sequence
  Synthesized adaptor oligonucleotide
  misc_feature (34)..(36): n is a, c, g, or t
tgcaggaccagagaattcgaatacaactccactnnnctagcgttac

SEQ ID NO: 5881 - DNA, 46 bp, Artificial Sequence
  Synthesized adaptor oligonucleotide
  misc_feature (34)..(36): n is a, c, g, or t
tgcaggaccagagaattcgaatacaccaaatatnnnctagcgttac

SEQ ID NO: 5882 - DNA, 46 bp, Artificial Sequence
  Synthesized adaptor oligonucleotide
  misc_feature (34)..(36): n is a, c, g, or t
tgcaggaccagagaattcgaatacacaagatggnnnctagcgttac

SEQ ID NO: 5883 - DNA, 46 bp, Artificial Sequence
  Synthesized adaptor oligonucleotide
  misc_feature (34)..(36): n is a, c, g, or t
tgcaggaccagagaattcgaatacacccaaggcnnnctagcgttac

SEQ ID NO: 5884 - DNA, 46 bp, Artificial Sequence
  Synthesized adaptor oligonucleotide
  misc_feature (34)..(36): n is a, c, g, or t
tgcaggaccagagaattcgaatacataagcggannnctagcgttac

SEQ ID NO: 5885 - DNA, 46 bp, Artificial Sequence
  Synthesized adaptor oligonucleotide
  misc_feature (34)..(36): n is a, c, g, or t
tgcaggaccagagaattcgaatacagaggccctnnnctagcgttac

SEQ ID NO: 5886 - DNA, 46 bp, Artificial Sequence
  Synthesized adaptor oligonucleotide
  misc_feature (34)..(36): n is a, c, g, or t
tgcaggaccagagaattcgaatacacttcctagnnnctagcgttac

SEQ ID NO: 5887 - DNA, 46 bp, Artificial Sequence
  Synthesized adaptor oligonucleotide
  misc_feature (34)..(36): n is a, c, g, or t
tgcaggaccagagaattcgaatacacgcagaaannnctagcgttac

SEQ ID NO: 5888 - DNA, 46 bp, Artificial Sequence
  Synthesized adaptor oligonucleotide
  misc_feature (34)..(36): n is a, c, g, or t
tgcaggaccagagaattcgaatacatgtgcgtannnctagcgttac

SEQ ID NO: 5889 - DNA, 46 bp, Artificial Sequence
  Synthesized adaptor oligonucleotide
  misc_feature (34)..(36): n is a, c, g, or t
tgcaggaccagagaattcgaatacacgatggaannngatcgacatg

SEQ ID NO: 5890 - DNA, 46 bp, Artificial Sequence
  Synthesized adaptor oligonucleotide
  misc_feature (34)..(36): n is a, c, g, or t
tgcaggaccagagaattcgaatacaccaattaannngatcgacatg

SEQ ID NO: 5891 - DNA, 46 bp, Artificial Sequence
  Synthesized adaptor oligonucleotide
  misc_feature (34)..(36): n is a, c, g, or t
tgcaggaccagagaattcgaatacacataggctnnngatcgacatg

SEQ ID NO: 5892 - DNA, 46 bp, Artificial Sequence
  Synthesized adaptor oligonucleotide
  misc_feature (34)..(36): n is a, c, g, or t
tgcaggaccagagaattcgaatacaaaaaaattnnngatcgacatg

SEQ ID NO: 5893 - DNA, 46 bp, Artificial Sequence
  Synthesized adaptor oligonucleotide
  misc_feature (34)..(36): n is a, c, g, or t
tgcaggaccagagaattcgaatacaaatacactnnngatcgacatg

SEQ ID NO: 5894 - DNA, 46 bp, Artificial Sequence
  Synthesized adaptor oligonucleotide
  misc_feature (34)..(36): n is a, c, g, or t
tgcaggaccagagaattcgaatacaaatcgaaannngatcgacatg

SEQ ID NO: 5895 - DNA, 46 bp, Artificial Sequence
  Synthesized adaptor oligonucleotide
  misc_feature (34)..(36): n is a, c, g, or t
tgcaggaccagagaattcgaatacatctattacnnngatcgacatg

SEQ ID NO: 5896 - DNA, 46 bp, Artificial Sequence
  Synthesized adaptor oligonucleotide
  misc_feature (34)..(36): n is a, c, g, or t
tgcaggaccagagaattcgaatacaacccgatannngatcgacatg

SEQ ID NO: 5897 - DNA, 46 bp, Artificial Sequence
  Synthesized adaptor oligonucleotide
  misc_feature (34)..(36): n is a, c, g, or t
tgcaggaccagagaattcgaatacagaaacgcannngatcgacatg

SEQ ID NO: 5898 - DNA, 46 bp, Artificial Sequence
  Synthesized adaptor oligonucleotide
  misc_feature (34)..(36): n is a, c, g, or t
tgcaggaccagagaattcgaatacagtgatcgtnnngatcgacatg

SEQ ID NO: 5899 - DNA, 46 bp, Artificial Sequence
  Synthesized adaptor oligonucleotide
  misc_feature (34)..(36): n is a, c, g, or t
tgcaggaccagagaattcgaatacacgcagccannngatcgacatg

SEQ ID NO: 5900 - DNA, 46 bp, Artificial Sequence
  Synthesized adaptor oligonucleotide
  misc_feature (34)..(36): n is a, c, g, or t
tgcaggaccagagaattcgaatacatgaccatgnnngatcgacatg

SEQ ID NO: 5901 - DNA, 46 bp, Artificial Sequence
  Synthesized adaptor oligonucleotide
  misc_feature (34)..(36): n is a, c, g, or t
tgcaggaccagagaattcgaatacaggtccacgnnngatcgacatg

SEQ ID NO: 5902 - DNA, 46 bp, Artificial Sequence
  Synthesized adaptor oligonucleotide
  misc_feature (34)..(36): n is a, c, g, or t
tgcaggaccagagaattcgaatacaaagcataannngatcgacatg

SEQ ID NO: 5903 - DNA, 46 bp, Artificial Sequence
  Synthesized adaptor oligonucleotide
  misc_feature (34)..(36): n is a, c, g, or t
tgcaggaccagagaattcgaatacagacaggcgnnngatcgacatg

SEQ ID NO: 5904 - DNA, 46 bp, Artificial Sequence
  Synthesized adaptor oligonucleotide
  misc_feature (34)..(36): n is a, c, g, or t
tgcaggaccagagaattcgaatacaacggtagannngatcgacatg

SEQ ID NO: 5905 - DNA, 46 bp, Artificial Sequence
  Synthesized adaptor oligonucleotide
  misc_feature (34)..(36): n is a, c, g, or t
tgcaggaccagagaattcgaatacatcattactnnngatcgacatg

SEQ ID NO: 5906 - DNA, 46 bp, Artificial Sequence
  Synthesized adaptor oligonucleotide
  misc_feature (34)..(36): n is a, c, g, or t
tgcaggaccagagaattcgaatacacgaaaatannngatcgacatg

SEQ ID NO: 5907 - DNA, 46 bp, Artificial Sequence
  Synthesized adaptor oligonucleotide
  misc_feature (34)..(36): n is a, c, g, or t
tgcaggaccagagaattcgaatacatggaaggtnnngatcgacatg

SEQ ID NO: 5908 - DNA, 46 bp, Artificial Sequence
  Synthesized adaptor oligonucleotide
  misc_feature (34)..(36): n is a, c, g, or t
tgcaggaccagagaattcgaatacactgttttannngatcgacatg

SEQ ID NO: 5909 - DNA, 46 bp, Artificial Sequence
  Synthesized adaptor oligonucleotide
  misc_feature (34)..(36): n is a, c, g, or t
tgcaggaccagagaattcgaatacacggatttgnnngatcgacatg

SEQ ID NO: 5910 - DNA, 46 bp, Artificial Sequence
  Synthesized adaptor oligonucleotide
  misc_feature (34)..(36): n is a, c, g, or t
tgcaggaccagagaattcgaatacacgtggtgcnnngatcgacatg

SEQ ID NO: 5911 - DNA, 46 bp, Artificial Sequence
  Synthesized adaptor oligonucleotide
  misc_feature (34)..(36): n is a, c, g, or t
tgcaggaccagagaattcgaatacaatgcctctnnngatcgacatg

SEQ ID NO: 5912 - DNA, 46 bp, Artificial Sequence
  Synthesized adaptor oligonucleotide
  misc_feature (34)..(36): n is a, c, g, or t
tgcaggaccagagaattcgaatacaagagaaggnnngatcgacatg

SEQ ID NO: 5913 - DNA, 46 bp, Artificial Sequence
  Synthesized adaptor oligonucleotide
  misc_feature (34)..(36): n is a, c, g, or t
tgcaggaccagagaattcgaatacatcatggtgnnngatcgacatg

SEQ ID NO: 5914 - DNA, 46 bp, Artificial Sequence
  Synthesized adaptor oligonucleotide
  misc_feature (34)..(36): n is a, c, g, or t
tgcaggaccagagaattcgaatacactggagccnnngatcgacatg

SEQ ID NO: 5915 - DNA, 46 bp, Artificial Sequence
  Synthesized adaptor oligonucleotide
  misc_feature (34)..(36): n is a, c, g, or t
tgcaggaccagagaattcgaatacactgttaggnnngatcgacatg

SEQ ID NO: 5916 - DNA, 46 bp, Artificial Sequence
  Synthesized adaptor oligonucleotide
  misc_feature (34)..(36): n is a, c, g, or t
tgcaggaccagagaattcgaatacactggttctnnngatcgacatg

SEQ ID NO: 5917 - DNA, 46 bp, Artificial Sequence
  Synthesized adaptor oligonucleotide
  misc_feature (34)..(36): n is a, c, g, or t
tgcaggaccagagaattcgaatacacaaagtccnnngatcgacatg

SEQ ID NO: 5918 - DNA, 46 bp, Artificial Sequence
  Synthesized adaptor oligonucleotide
  misc_feature (34)..(36): n is a, c, g, or t
tgcaggaccagagaattcgaatacacgtagccgnnngatcgacatg

SEQ ID NO: 5919 - DNA, 46 bp, Artificial Sequence
  Synthesized adaptor oligonucleotide
  misc_feature (34)..(36): n is a, c, g, or t
tgcaggaccagagaattcgaatacaaggctgaannngatcgacatg

SEQ ID NO: 5920 - DNA, 46 bp, Artificial Sequence
  Synthesized adaptor oligonucleotide
  misc_feature (34)..(36): n is a, c, g, or t
tgcaggaccagagaattcgaatacactaatcttnnngatcgacatg

SEQ ID NO: 5921 - DNA, 46 bp, Artificial Sequence
  Synthesized adaptor oligonucleotide
  misc_feature (34)..(36): n is a, c, g, or t
tgcaggaccagagaattcgaatacagacttaatnnngatcgacatg

SEQ ID NO: 5922 - DNA, 46 bp, Artificial Sequence
  Synthesized adaptor oligonucleotide
  misc_feature (34)..(36): n is a, c, g, or t
tgcaggaccagagaattcgaatacaatcacaatnnngatcgacatg

SEQ ID NO: 5923 - DNA, 46 bp, Artificial Sequence
  Synthesized adaptor oligonucleotide
  misc_feature (34)..(36): n is a, c, g, or t
tgcaggaccagagaattcgaatacagagcctgcnnngatcgacatg

SEQ ID NO: 5924 - DNA, 46 bp, Artificial Sequence
  Synthesized adaptor oligonucleotide
  misc_feature (34)..(36): n is a, c, g, or t
tgcaggaccagagaattcgaatacactctaggannngatcgacatg

SEQ ID NO: 5925 - DNA, 46 bp, Artificial Sequence
  Synthesized adaptor oligonucleotide
  misc_feature (34)..(36): n is a, c, g, or t
tgcaggaccagagaattcgaatacaggtgagatnnngatcgacatg

SEQ ID NO: 5926 - DNA, 46 bp, Artificial Sequence
  Synthesized adaptor oligonucleotide
  misc_feature (34)..(36): n is a, c, g, or t
tgcaggaccagagaattcgaatacaaggttgctnnngatcgacatg

SEQ ID NO: 5927 - DNA, 46 bp, Artificial Sequence
  Synthesized adaptor oligonucleotide
  misc_feature (34)..(36): n is a, c, g, or t
tgcaggaccagagaattcgaatacagaggtgcgnnngatcgacatg

SEQ ID NO: 5928 - DNA, 46 bp, Artificial Sequence
  Synthesized adaptor oligonucleotide
  misc_feature (34)..(36): n is a, c, g, or t
tgcaggaccagagaattcgaatacaactcagacnnngatcgacatg

SEQ ID NO: 5929 - DNA, 46 bp, Artificial Sequence
  Synthesized adaptor oligonucleotide
  misc_feature (34)..(36): n is a, c, g, or t
tgcaggaccagagaattcgaatacacaatgtatnnngatcgacatg

SEQ ID NO: 5930 - DNA, 46 bp, Artificial Sequence
  Synthesized adaptor oligonucleotide
  misc_feature (34)..(36): n is a, c, g, or t
tgcaggaccagagaattcgaatacaaaccattannngatcgacatg

SEQ ID NO: 5931 - DNA, 46 bp, Artificial Sequence
  Synthesized adaptor oligonucleotide
  misc_feature (34)..(36): n is a, c, g, or t
tgcaggaccagagaattcgaatacatggcgctgnnngatcgacatg

SEQ ID NO: 5932 - DNA, 46 bp, Artificial Sequence
  Synthesized adaptor oligonucleotide
  misc_feature (34)..(36): n is a, c, g, or t
tgcaggaccagagaattcgaatacacgccctgtnnngatcgacatg

SEQ ID NO: 5933 - DNA, 46 bp, Artificial Sequence
  Synthesized adaptor oligonucleotide
  misc_feature (34)..(36): n is a, c, g, or t
tgcaggaccagagaattcgaatacatagccgtannngatcgacatg

SEQ ID NO: 5934 - DNA, 46 bp, Artificial Sequence
  Synthesized adaptor oligonucleotide
  misc_feature (34)..(36): n is a, c, g, or t
tgcaggaccagagaattcgaatacaggatagtgnnngatcgacatg

SEQ ID NO: 5935 - DNA, 46 bp, Artificial Sequence
  Synthesized adaptor oligonucleotide
  misc_feature (34)..(36): n is a, c, g, or t
tgcaggaccagagaattcgaatacataaggcagnnngatcgacatg

SEQ ID NO: 5936 - DNA, 46 bp, Artificial Sequence
  Synthesized adaptor oligonucleotide
  misc_feature (34)..(36): n is a, c, g, or t
tgcaggaccagagaattcgaatacaaggtcctannngatcgacatg

SEQ ID NO: 5937 - DNA, 46 bp, Artificial Sequence
  Synthesized adaptor oligonucleotide
  misc_feature (34)..(36): n is a, c, g, or t
tgcaggaccagagaattcgaatacaaactggagnnngatcgacatg

SEQ ID NO: 5938 - DNA, 46 bp, Artificial Sequence
  Synthesized adaptor oligonucleotide
  misc_feature (34)..(36): n is a, c, g, or t
tgcaggaccagagaattcgaatacattgttgttnnngatcgacatg

SEQ ID NO: 5939 - DNA, 46 bp, Artificial Sequence
  Synthesized adaptor oligonucleotide
  misc_feature (34)..(36): n is a, c, g, or t
tgcaggaccagagaattcgaatacagcgaagcgnnngatcgacatg

SEQ ID NO: 5940 - DNA, 46 bp, Artificial Sequence
  Synthesized adaptor oligonucleotide
  misc_feature (34)..(36): n is a, c, g, or t
tgcaggaccagagaattcgaatacaagatccgtnnngatcgacatg

SEQ ID NO: 5941 - DNA, 46 bp, Artificial Sequence
  Synthesized adaptor oligonucleotide
  misc_feature (34)..(36): n is a, c, g, or t
tgcaggaccagagaattcgaatacaataccgtgnnngatcgacatg

SEQ ID NO: 5942 - DNA, 46 bp, Artificial Sequence
  Synthesized adaptor oligonucleotide
  misc_feature (34)..(36): n is a, c, g, or t
tgcaggaccagagaattcgaatacaaatcatgtnnngatcgacatg

SEQ ID NO: 5943 - DNA, 46 bp, Artificial Sequence
  Synthesized adaptor oligonucleotide
  misc_feature (34)..(36): n is a, c, g, or t
tgcaggaccagagaattcgaatacatgttttgtnnngatcgacatg

SEQ ID NO: 5944 - DNA, 46 bp, Artificial Sequence
  Synthesized adaptor oligonucleotide
  misc_feature (34)..(36): n is a, c, g, or t
tgcaggaccagagaattcgaatacaggatacagnnngatcgacatg

SEQ ID NO: 5945 - DNA, 46 bp, Artificial Sequence
  Synthesized adaptor oligonucleotide
  misc_feature (34)..(36): n is a, c, g, or t
tgcaggaccagagaattcgaatacagttcgtagnnngatcgacatg

SEQ ID NO: 5946 - DNA, 46 bp, Artificial Sequence
  Synthesized adaptor oligonucleotide
  misc_feature (34)..(36): n is a, c, g, or t
tgcaggaccagagaattcgaatacaggagatcannngatcgacatg

SEQ ID NO: 5947 - DNA, 46 bp, Artificial Sequence
  Synthesized adaptor oligonucleotide
  misc_feature (34)..(36): n is a, c, g, or t
tgcaggaccagagaattcgaatacactttgttannngatcgacatg

SEQ ID NO: 5948 - DNA, 46 bp, Artificial Sequence
  Synthesized adaptor oligonucleotide
  misc_feature (34)..(36): n is a, c, g, or t
tgcaggaccagagaattcgaatacagtgaacctnnngatcgacatg

SEQ ID NO: 5949 - DNA, 46 bp, Artificial Sequence
  Synthesized adaptor oligonucleotide
  misc_feature (34)..(36): n is a, c, g, or t
tgcaggaccagagaattcgaatacacctacagannntgcatcaggt

SEQ ID NO: 5950 - DNA, 46 bp, Artificial Sequence
  Synthesized adaptor oligonucleotide
  misc_feature (34)..(36): n is a, c, g, or t
tgcaggaccagagaattcgaatacagcatcgatnnntgcatcaggt

SEQ ID NO: 5951 - DNA, 46 bp, Artificial Sequence
  Synthesized adaptor oligonucleotide
  misc_feature (34)..(36): n is a, c, g, or t
tgcaggaccagagaattcgaatacatactgctcnnntgcatcaggt

SEQ ID NO: 5952 - DNA, 46 bp, Artificial Sequence
  Synthesized adaptor oligonucleotide
  misc_feature (34)..(36): n is a, c, g, or t
tgcaggaccagagaattcgaatacacctgttgtnnntgcatcaggt

SEQ ID NO: 5953 - DNA, 46 bp, Artificial Sequence
  Synthesized adaptor oligonucleotide
  misc_feature (34)..(36): n is a, c, g, or t
tgcaggaccagagaattcgaatacagagtcgaannntgcatcaggt

SEQ ID NO: 5954 - DNA, 46 bp, Artificial Sequence
  Synthesized adaptor oligonucleotide
  misc_feature (34)..(36): n is a, c, g, or t
tgcaggaccagagaattcgaatacattgaccagnnntgcatcaggt

SEQ ID NO: 5955 - DNA, 46 bp, Artificial Sequence
  Synthesized adaptor oligonucleotide
  misc_feature (34)..(36): n is a, c, g, or t
tgcaggaccagagaattcgaatacaatggttatnnntgcatcaggt

SEQ ID NO: 5956 - DNA, 46 bp, Artificial Sequence
  Synthesized adaptor oligonucleotide
  misc_feature (34)..(36): n is a, c, g, or t
tgcaggaccagagaattcgaatacagcgctcagnnntgcatcaggt

SEQ ID NO: 5957 - DNA, 46 bp, Artificial Sequence
  Synthesized adaptor oligonucleotide
  misc_feature (34)..(36): n is a, c, g, or t
tgcaggaccagagaattcgaatacatggacccgnnntgcatcaggt

SEQ ID NO: 5958 - DNA, 46 bp, Artificial Sequence
  Synthesized adaptor oligonucleotide
  misc_feature (34)..(36): n is a, c, g, or t
tgcaggaccagagaattcgaatacattaccaccnnntgcatcaggt

SEQ ID NO: 5959 - DNA, 46 bp, Artificial Sequence
  Synthesized adaptor oligonucleotide
  misc_feature (34)..(36): n is a, c, g, or t
tgcaggaccagagaattcgaatacagtataactnnntgcatcaggt

SEQ ID NO: 5960 - DNA, 46 bp, Artificial Sequence
  Synthesized adaptor oligonucleotide
  misc_feature (34)..(36): n is a, c, g, or t
tgcaggaccagagaattcgaatacagcccgtgannntgcatcaggt

SEQ ID NO: 5961 - DNA, 46 bp, Artificial Sequence
  Synthesized adaptor oligonucleotide
  misc_feature (34)..(36): n is a, c, g, or t
tgcaggaccagagaattcgaatacactgatgacnnntgcatcaggt

SEQ ID NO: 5962 - DNA, 46 bp, Artificial Sequence
  Synthesized adaptor oligonucleotide
  misc_feature (34)..(36): n is a, c, g, or t
tgcaggaccagagaattcgaatacacatggcatnnntgcatcaggt

SEQ ID NO: 5963 - DNA, 46 bp, Artificial Sequence
  Synthesized adaptor oligonucleotide
  misc_feature (34)..(36): n is a, c, g, or t
tgcaggaccagagaattcgaatacaatgatatcnnntgcatcaggt

SEQ ID NO: 5964 - DNA, 46 bp, Artificial Sequence
  Synthesized adaptor oligonucleotide
  misc_feature (34)..(36): n is a, c, g, or t
tgcaggaccagagaattcgaatacatgtaaaagnnntgcatcaggt

SEQ ID NO: 5965 - DNA, 46 bp, Artificial Sequence
  Synthesized adaptor oligonucleotide
  misc_feature (34)..(36): n is a, c, g, or t
tgcaggaccagagaattcgaatacaccttgccgnnntgcatcaggt

SEQ ID NO: 5966 - DNA, 46 bp, Artificial Sequence
  Synthesized adaptor oligonucleotide
  misc_feature (34)..(36): n is a, c, g, or t
tgcaggaccagagaattcgaatacagaggcacgnnntgcatcaggt

SEQ ID NO: 5967 - DNA, 46 bp, Artificial Sequence
  Synthesized adaptor oligonucleotide
  misc_feature (34)..(36): n is a, c, g, or t
tgcaggaccagagaattcgaatacacctgagcgnnntgcatcaggt

SEQ ID NO: 5968 - DNA, 46 bp, Artificial Sequence
  Synthesized adaptor oligonucleotide
  misc_feature (34)..(36): n is a, c, g, or t
tgcaggaccagagaattcgaatacaggttgctannntgcatcaggt

SEQ ID NO: 5969 - DNA, 46 bp, Artificial Sequence
  Synthesized adaptor oligonucleotide
  misc_feature (34)..(36): n is a, c, g, or t
tgcaggaccagagaattcgaatacagtcaaaggnnntgcatcaggt

SEQ ID NO: 5970 - DNA, 46 bp, Artificial Sequence
  Synthesized adaptor oligonucleotide
  misc_feature (34)..(36): n is a, c, g, or t
tgcaggaccagagaattcgaatacaacgtatgcnnntgcatcaggt

SEQ ID NO: 5971 - DNA, 46 bp, Artificial Sequence
  Synthesized adaptor oligonucleotide
  misc_feature (34)..(36): n is a, c, g, or t
tgcaggaccagagaattcgaatacacgagcggannntgcatcaggt

SEQ ID NO: 5972 - DNA, 46 bp, Artificial Sequence
  Synthesized adaptor oligonucleotide
  misc_feature (34)..(36): n is a, c, g, or t
tgcaggaccagagaattcgaatacattttgccgnnntgcatcaggt

SEQ ID NO: 5973 - DNA, 46 bp, Artificial Sequence
  Synthesized adaptor oligonucleotide
  misc_feature (34)..(36): n is a, c, g, or t
tgcaggaccagagaattcgaatacaaagtctgcnnntgcatcaggt

SEQ ID NO: 5974 - DNA, 46 bp, Artificial Sequence
  Synthesized adaptor oligonucleotide
  misc_feature (34)..(36): n is a, c, g, or t
tgcaggaccagagaattcgaatacacttccttcnnntgcatcaggt

SEQ ID NO: 5975 - DNA, 46 bp, Artificial Sequence
  Synthesized adaptor oligonucleotide
  misc_feature (34)..(36): n is a, c, g, or t
tgcaggaccagagaattcgaatacaatgtgaaannntgcatcaggt

SEQ ID NO: 5976 - DNA, 46 bp, Artificial Sequence
  Synthesized adaptor oligonucleotide
  misc_feature (34)..(36): n is a, c, g, or t
tgcaggaccagagaattcgaatacagccgtggtnnntgcatcaggt

SEQ ID NO: 5977 - DNA, 46 bp, Artificial Sequence
  Synthesized adaptor oligonucleotide
  misc_feature (34)..(36): n is a, c, g, or t
tgcaggaccagagaattcgaatacacagaggcgnnntgcatcaggt

SEQ ID NO: 5978 - DNA, 46 bp, Artificial Sequence
  Synthesized adaptor oligonucleotide
  misc_feature (34)..(36): n is a, c, g, or t
tgcaggaccagagaattcgaatacatttgatctnnntgcatcaggt

SEQ ID NO: 5979 - DNA, 46 bp, Artificial Sequence
  Synthesized adaptor oligonucleotide
  misc_feature (34)..(36): n is a, c, g, or t
tgcaggaccagagaattcgaatacagcgtcgacnnntgcatcaggt

SEQ ID NO: 5980 - DNA, 46 bp, Artificial Sequence
  Synthesized adaptor oligonucleotide
  misc_feature (34)..(36): n is a, c, g, or t
tgcaggaccagagaattcgaatacaggatataannntgcatcaggt

SEQ ID NO: 5981 - DNA, 46 bp, Artificial Sequence
  Synthesized adaptor oligonucleotide
  misc_feature (34)..(36): n is a, c, g, or t
tgcaggaccagagaattcgaatacaaaattttannntgcatcaggt

SEQ ID NO: 5982 - DNA, 46 bp, Artificial Sequence
  Synthesized adaptor oligonucleotide
  misc_feature (34)..(36): n is a, c, g, or t
tgcaggaccagagaattcgaatacaagcccgtgnnntgcatcaggt

SEQ ID NO: 5983 - DNA, 46 bp, Artificial Sequence
  Synthesized adaptor oligonucleotide
  misc_feature (34)..(36): n is a, c, g, or t
tgcaggaccagagaattcgaatacacaataaagnnntgcatcaggt

SEQ ID NO: 5984 - DNA, 46 bp, Artificial Sequence
  Synthesized adaptor oligonucleotide
  misc_feature (34)..(36): n is a, c, g, or t
tgcaggaccagagaattcgaatacagcgacattnnntgcatcaggt

SEQ ID NO: 5985 - DNA, 46 bp, Artificial Sequence
  Synthesized adaptor oligonucleotide
  misc_feature (34)..(36): n is a, c, g, or t
tgcaggaccagagaattcgaatacacagagagtnnntgcatcaggt

SEQ ID NO: 5986 - DNA, 46 bp, Artificial Sequence
  Synthesized adaptor oligonucleotide
  misc_feature (34)..(36): n is a, c, g, or t
tgcaggaccagagaattcgaatacacttcacacnnntgcatcaggt

SEQ ID NO: 5987 - DNA, 46 bp, Artificial Sequence
  Synthesized adaptor oligonucleotide
  misc_feature (34)..(36): n is a, c, g, or t
tgcaggaccagagaattcgaatacattaagctannntgcatcaggt

SEQ ID NO: 5988 - DNA, 46 bp, Artificial Sequence
  Synthesized adaptor oligonucleotide
  misc_feature (34)..(36): n is a, c, g, or t
tgcaggaccagagaattcgaatacagtgaccgcnnntgcatcaggt

SEQ ID NO: 5989 - DNA, 46 bp, Artificial Sequence
  Synthesized adaptor oligonucleotide
  misc_feature (34)..(36): n is a, c, g, or t
tgcaggaccagagaattcgaatacaccgatatgnnntgcatcaggt

SEQ ID NO: 5990 - DNA, 46 bp, Artificial Sequence
  Synthesized adaptor oligonucleotide
  misc_feature (34)..(36): n is a, c, g, or t
tgcaggaccagagaattcgaatacatagcattannntgcatcaggt

SEQ ID NO: 5991 - DNA, 46 bp, Artificial Sequence
  Synthesized adaptor oligonucleotide
  misc_feature (34)..(36): n is a, c, g, or t
tgcaggaccagagaattcgaatacactaggccgnnntgcatcaggt

SEQ ID NO: 5992 - DNA, 46 bp, Artificial Sequence
  Synthesized adaptor oligonucleotide
  misc_feature (34)..(36): n is a, c, g, or t
tgcaggaccagagaattcgaatacattagtaacnnntgcatcaggt

SEQ ID NO: 5993 - DNA, 46 bp, Artificial Sequence
  Synthesized adaptor oligonucleotide
  misc_feature (34)..(36): n is a, c, g, or t
tgcaggaccagagaattcgaatacatatcacggnnntgcatcaggt

SEQ ID NO: 5994 - DNA, 46 bp, Artificial Sequence
  Synthesized adaptor oligonucleotide
  misc_feature (34)..(36): n is a, c, g, or t
tgcaggaccagagaattcgaatacacgattctcnnntgcatcaggt

SEQ ID NO: 5995 - DNA, 46 bp, Artificial Sequence
  Synthesized adaptor oligonucleotide
  misc_feature (34)..(36): n is a, c, g, or t
tgcaggaccagagaattcgaatacagaggaagannntgcatcaggt

SEQ ID NO: 5996 - DNA, 46 bp, Artificial Sequence
  Synthesized adaptor oligonucleotide
  misc_feature (34)..(36): n is a, c, g, or t
tgcaggaccagagaattcgaatacatgtctgctnnntgcatcaggt

SEQ ID NO: 5997 - DNA, 46 bp, Artificial Sequence
  Synthesized adaptor oligonucleotide
  misc_feature (34)..(36): n is a, c, g, or t
tgcaggaccagagaattcgaatacaaatactcannntgcatcaggt

SEQ ID NO: 5998 - DNA, 46 bp, Artificial Sequence
  Synthesized adaptor oligonucleotide
  misc_feature (34)..(36): n is a, c, g, or t
tgcaggaccagagaattcgaatacatagttcccnnntgcatcaggt

SEQ ID NO: 5999 - DNA, 46 bp, Artificial Sequence
  Synthesized adaptor oligonucleotide
  misc_feature (34)..(36): n is a, c, g, or t
tgcaggaccagagaattcgaatacaaattcgtannntgcatcaggt

SEQ ID NO: 6000 - DNA, 46 bp, Artificial Sequence
  Synthesized adaptor oligonucleotide
  misc_feature (34)..(36): n is a, c, g, or t
tgcaggaccagagaattcgaatacagctgattgnnntgcatcaggt

SEQ ID NO: 6001 - DNA, 46 bp, Artificial Sequence
  Synthesized adaptor oligonucleotide
  misc_feature (34)..(36): n is a, c, g, or t
tgcaggaccagagaattcgaatacatacccgaannntgcatcaggt

SEQ ID NO: 6002 - DNA, 46 bp, Artificial Sequence
  Synthesized adaptor oligonucleotide
  misc_feature (34)..(36): n is a, c, g, or t
tgcaggaccagagaattcgaatacaaggccattnnntgcatcaggt

SEQ ID NO: 6003 - DNA, 46 bp, Artificial Sequence
  Synthesized adaptor oligonucleotide
  misc_feature (34)..(36): n is a, c, g, or t
tgcaggaccagagaattcgaatacagctccccannntgcatcaggt

SEQ ID NO: 6004 - DNA, 46 bp, Artificial Sequence
  Synthesized adaptor oligonucleotide
  misc_feature (34)..(36): n is a, c, g, or t
tgcaggaccagagaattcgaatacatgaacgctnnntgcatcaggt

SEQ ID NO: 6005 - DNA, 46 bp, Artificial Sequence
  Synthesized adaptor oligonucleotide
  misc_feature (34)..(36): n is a, c, g, or t
tgcaggaccagagaattcgaatacacgaggcagnnntgcatcaggt

SEQ ID NO: 6006 - DNA, 46 bp, Artificial Sequence
  Synthesized adaptor oligonucleotide
  misc_feature (34)..(36): n is a, c, g, or t
tgcaggaccagagaattcgaatacaggtgctatnnntgcatcaggt

SEQ ID NO: 6007 - DNA, 46 bp, Artificial Sequence
  Synthesized adaptor oligonucleotide
  misc_feature (34)..(36): n is a, c, g, or t
tgcaggaccagagaattcgaatacaaattgccgnnntgcatcaggt

SEQ ID NO: 6008 - DNA, 46 bp, Artificial Sequence
  Synthesized adaptor oligonucleotide
  misc_feature (34)..(36): n is a, c, g, or t
tgcaggaccagagaattcgaatacaggccgactnnntgcatcaggt

SEQ ID NO: 6009 - DNA, 46 bp, Artificial Sequence
  Synthesized adaptor oligonucleotide
  misc_feature (34)..(36): n is a, c, g, or t
tgcaggaccagagaattcgaatacactctgctannnacgtatgcca

SEQ ID NO: 6010 - DNA, 46 bp, Artificial Sequence
  Synthesized adaptor oligonucleotide
  misc_feature (34)..(36): n is a, c, g, or t
tgcaggaccagagaattcgaatacattacatgannnacgtatgcca

SEQ ID NO: 6011 - DNA, 46 bp, Artificial Sequence
  Synthesized adaptor oligonucleotide
  misc_feature (34)..(36): n is a, c, g, or t
tgcaggaccagagaattcgaatacacgaggatannnacgtatgcca

SEQ ID NO: 6012 - DNA, 46 bp, Artificial Sequence
  Synthesized adaptor oligonucleotide
  misc_feature (34)..(36): n is a, c, g, or t
tgcaggaccagagaattcgaatacacgacatgtnnnacgtatgcca

SEQ ID NO: 6013 - DNA, 46 bp, Artificial Sequence
  Synthesized adaptor oligonucleotide
  misc_feature (34)..(36): n is a, c, g, or t
tgcaggaccagagaattcgaatacaccttgaagnnnacgtatgcca

SEQ ID NO: 6014 - DNA, 46 bp, Artificial Sequence
  Synthesized adaptor oligonucleotide
  misc_feature (34)..(36): n is a, c, g, or t
tgcaggaccagagaattcgaatacacaacgatcnnnacgtatgcca

SEQ ID NO: 6015 - DNA, 46 bp, Artificial Sequence
  Synthesized adaptor oligonucleotide
  misc_feature (34)..(36): n is a, c, g, or t
tgcaggaccagagaattcgaatacagactagagnnnacgtatgcca

SEQ ID NO: 6016 - DNA, 46 bp, Artificial Sequence
  Synthesized adaptor oligonucleotide
  misc_feature (34)..(36): n is a, c, g, or t
tgcaggaccagagaattcgaatacactgcagtannnacgtatgcca

SEQ ID NO: 6017 - DNA, 46 bp, Artificial Sequence
  Synthesized adaptor oligonucleotide
  misc_feature (34)..(36): n is a, c, g, or t
tgcaggaccagagaattcgaatacaatgtgaccnnnacgtatgcca

SEQ ID NO: 6018 - DNA, 46 bp, Artificial Sequence
  Synthesized adaptor oligonucleotide
  misc_feature (34)..(36): n is a, c, g, or t
tgcaggaccagagaattcgaatacaacgaatttnnnacgtatgcca

SEQ ID NO: 6019 - DNA, 46 bp, Artificial Sequence
  Synthesized adaptor oligonucleotide
  misc_feature (34)..(36): n is a, c, g, or t
tgcaggaccagagaattcgaatacaattgtttcnnnacgtatgcca

SEQ ID NO: 6020 - DNA, 46 bp, Artificial Sequence
  Synthesized adaptor oligonucleotide
  misc_feature (34)..(36): n is a, c, g, or t
tgcaggaccagagaattcgaatacacgccgtgannnacgtatgcca

SEQ ID NO: 6021 - DNA, 46 bp, Artificial Sequence
  Synthesized adaptor oligonucleotide
  misc_feature (34)..(36): n is a, c, g, or t
tgcaggaccagagaattcgaatacacactcaagnnnacgtatgcca

SEQ ID NO: 6022 - DNA, 46 bp, Artificial Sequence
  Synthesized adaptor oligonucleotide
  misc_feature (34)..(36): n is a, c, g, or t
tgcaggaccagagaattcgaatacaagcaatccnnnacgtatgcca

SEQ ID NO: 6023 - DNA, 46 bp, Artificial Sequence
  Synthesized adaptor oligonucleotide
  misc_feature (34)..(36): n is a, c, g, or t
tgcaggaccagagaattcgaatacatccattatnnnacgtatgcca

SEQ ID NO: 6024 - DNA, 46 bp, Artificial Sequence
  Synthesized adaptor oligonucleotide
  misc_feature (34)..(36): n is a, c, g, or t
tgcaggaccagagaattcgaatacaaattgctannnacgtatgcca

SEQ ID NO: 6025 - DNA, 46 bp, Artificial Sequence
  Synthesized adaptor oligonucleotide
  misc_feature (34)..(36): n is a, c, g, or t
tgcaggaccagagaattcgaatacacgatccaannnacgtatgcca

SEQ ID NO: 6026 - DNA, 46 bp, Artificial Sequence
  Synthesized adaptor oligonucleotide
  misc_feature (34)..(36): n is a, c, g, or t
tgcaggaccagagaattcgaatacactcggtggnnnacgtatgcca

SEQ ID NO: 6027 - DNA, 46 bp, Artificial Sequence
  Synthesized adaptor oligonucleotide
  misc_feature (34)..(36): n is a, c, g, or t
tgcaggaccagagaattcgaatacagagattaannnacgtatgcca

SEQ ID NO: 6028 - DNA, 46 bp, Artificial Sequence
  Synthesized adaptor oligonucleotide
  misc_feature (34)..(36): n is a, c, g, or t
tgcaggaccagagaattcgaatacaatcaggctnnnacgtatgcca

SEQ ID NO: 6029 - DNA, 46 bp, Artificial Sequence
  Synthesized adaptor oligonucleotide
  misc_feature (34)..(36): n is a, c, g, or t
tgcaggaccagagaattcgaatacagcggcccgnnnacgtatgcca

SEQ ID NO: 6030 - DNA, 46 bp, Artificial Sequence
  Synthesized adaptor oligonucleotide
  misc_feature (34)..(36): n is a, c, g, or t
tgcaggaccagagaattcgaatacatttaaatannnacgtatgcca

SEQ ID NO: 6031 - DNA, 46 bp, Artificial Sequence
  Synthesized adaptor oligonucleotide
  misc_feature (34)..(36): n is a, c, g, or t
tgcaggaccagagaattcgaatacacatggcgcnnnacgtatgcca

SEQ ID NO: 6032 - DNA, 46 bp, Artificial Sequence
  Synthesized adaptor oligonucleotide
  misc_feature (34)..(36): n is a, c, g, or t
tgcaggaccagagaattcgaatacatcggttagnnnacgtatgcca

SEQ ID NO: 6033 - DNA, 46 bp, Artificial Sequence
  Synthesized adaptor oligonucleotide
  misc_feature (34)..(36): n is a, c, g, or t
tgcaggaccagagaattcgaatacacgcctggannnacgtatgcca

SEQ ID NO: 6034 - DNA, 46 bp, Artificial Sequence
  Synthesized adaptor oligonucleotide
  misc_feature (34)..(36): n is a, c, g, or t
tgcaggaccagagaattcgaatacattcctgtgnnnacgtatgcca

SEQ ID NO: 6035 - DNA, 46 bp, Artificial Sequence
  Synthesized adaptor oligonucleotide
  misc_feature (34)..(36): n is a, c, g, or t
tgcaggaccagagaattcgaatacaggcgcctannnacgtatgcca

SEQ ID NO: 6036 - DNA, 46 bp, Artificial Sequence
  Synthesized adaptor oligonucleotide
  misc_feature (34)..(36): n is a, c, g, or t
tgcaggaccagagaattcgaatacacccggcggnnnacgtatgcca

SEQ ID NO: 6037 - DNA, 46 bp, Artificial Sequence
  Synthesized adaptor oligonucleotide
  misc_feature (34)..(36): n is a, c, g, or t
tgcaggaccagagaattcgaatacaattcggcannnacgtatgcca

SEQ ID NO: 6038 - DNA, 46 bp, Artificial Sequence
  Synthesized adaptor oligonucleotide
  misc_feature (34)..(36): n is a, c, g, or t
tgcaggaccagagaattcgaatacacaaatgaannnacgtatgcca

SEQ ID NO: 6039 - DNA, 46 bp, Artificial Sequence
  Synthesized adaptor oligonucleotide
  misc_feature (34)..(36): n is a, c, g, or t
tgcaggaccagagaattcgaatacataggatggnnnacgtatgcca

SEQ ID NO: 6040 - DNA, 46 bp, Artificial Sequence
  Synthesized adaptor oligonucleotide
  misc_feature (34)..(36): n is a, c, g, or t
tgcaggaccagagaattcgaatacattggacgtnnnacgtatgcca

SEQ ID NO: 6041 - DNA, 46 bp, Artificial Sequence
  Synthesized adaptor oligonucleotide
  misc_feature (34)..(36): n is a, c, g, or t
tgcaggaccagagaattcgaatacatcgtgagtnnnacgtatgcca

SEQ ID NO: 6042 - DNA, 46 bp, Artificial Sequence
  Synthesized adaptor oligonucleotide
  misc_feature (34)..(36): n is a, c, g, or t
tgcaggaccagagaattcgaatacaggaacttcnnnacgtatgcca

SEQ ID NO: 6043 - DNA, 46 bp, Artificial Sequence
  Synthesized adaptor oligonucleotide
  misc_feature (34)..(36): n is a, c, g, or t
tgcaggaccagagaattcgaatacaatgtgccannnacgtatgcca

SEQ ID NO: 6044 - DNA, 46 bp, Artificial Sequence
  Synthesized adaptor oligonucleotide
  misc_feature (34)..(36): n is a, c, g, or t
tgcaggaccagagaattcgaatacaccggtgcannnacgtatgcca

SEQ ID NO: 6045 - DNA, 46 bp, Artificial Sequence
  Synthesized adaptor oligonucleotide
  misc_feature (34)..(36): n is a, c, g, or t
tgcaggaccagagaattcgaatacactattgccnnnacgtatgcca

SEQ ID NO: 6046 - DNA, 46 bp, Artificial Sequence
  Synthesized adaptor oligonucleotide
  misc_feature (34)..(36): n is a, c, g, or t
tgcaggaccagagaattcgaatacattaaggccnnnacgtatgcca

SEQ ID NO: 6047 - DNA, 46 bp, Artificial Sequence
  Synthesized adaptor oligonucleotide
  misc_feature (34)..(36): n is a, c, g, or t
tgcaggaccagagaattcgaatacatgttaaacnnnacgtatgcca

SEQ ID NO: 6048 - DNA, 46 bp, Artificial Sequence
  Synthesized adaptor oligonucleotide
  misc_feature (34)..(36): n is a, c, g, or t
tgcaggaccagagaattcgaatacacttggttcnnnacgtatgcca

SEQ ID NO: 6049 - DNA, 46 bp, Artificial Sequence
  Synthesized adaptor oligonucleotide
  misc_feature (34)..(36): n is a, c, g, or t
tgcaggaccagagaattcgaatacaggtaatttnnnacgtatgcca

SEQ ID NO: 6050 - DNA, 46 bp, Artificial Sequence
  Synthesized adaptor oligonucleotide
  misc_feature (34)..(36): n is a, c, g, or t
tgcaggaccagagaattcgaatacaattatcagnnnacgtatgcca

SEQ ID NO: 6051 - DNA, 46 bp, Artificial Sequence
  Synthesized adaptor oligonucleotide
  misc_feature (34)..(36): n is a, c, g, or t
tgcaggaccagagaattcgaatacatgcgttctnnnacgtatgcca

SEQ ID NO: 6052 - DNA, 46 bp, Artificial Sequence
  Synthesized adaptor oligonucleotide
  misc_feature (34)..(36): n is a, c, g, or t
tgcaggaccagagaattcgaatacatgatccagnnnacgtatgcca

SEQ ID NO: 6053 - DNA, 46 bp, Artificial Sequence
  Synthesized adaptor oligonucleotide
  misc_feature (34)..(36): n is a, c, g, or t
tgcaggaccagagaattcgaatacacagttcagnnnacgtatgcca

SEQ ID NO: 6054 - DNA, 46 bp, Artificial Sequence
  Synthesized adaptor oligonucleotide
  misc_feature (34)..(36): n is a, c, g, or t
tgcaggaccagagaattcgaatacatgcgacatnnnacgtatgcca

SEQ ID NO: 6055 - DNA, 46 bp, Artificial Sequence
  Synthesized adaptor oligonucleotide
  misc_feature (34)..(36): n is a, c, g, or t
tgcaggaccagagaattcgaatacaagcagtagnnnacgtatgcca

SEQ ID NO: 6056 - DNA, 46 bp, Artificial Sequence
  Synthesized adaptor oligonucleotide
  misc_feature (34)..(36): n is a, c, g, or t
tgcaggaccagagaattcgaatacattagtgatnnnacgtatgcca

SEQ ID NO: 6057 - DNA, 46 bp, Artificial Sequence
  Synthesized adaptor oligonucleotide
  misc_feature (34)..(36): n is a, c, g, or t
tgcaggaccagagaattcgaatacacacattaannnacgtatgcca

SEQ ID NO: 6058 - DNA, 46 bp, Artificial Sequence
  Synthesized adaptor oligonucleotide
  misc_feature (34)..(36): n is a, c, g, or t
tgcaggaccagagaattcgaatacaaggtgcccnnnacgtatgcca

SEQ ID NO: 6059 - DNA, 46 bp, Artificial Sequence
  Synthesized adaptor oligonucleotide
  misc_feature (34)..(36): n is a, c, g, or t
tgcaggaccagagaattcgaatacaacctggcgnnnacgtatgcca

SEQ ID NO: 6060 - DNA, 46 bp, Artificial Sequence
  Synthesized adaptor oligonucleotide
  misc_feature (34)..(36): n is a, c, g, or t
tgcaggaccagagaattcgaatacacggcgatcnnnacgtatgcca

SEQ ID NO: 6061 - DNA, 46 bp, Artificial Sequence
  Synthesized adaptor oligonucleotide
  misc_feature (34)..(36): n is a, c, g, or t
tgcaggaccagagaattcgaatacatagacctgnnnacgtatgcca

SEQ ID NO: 6062 - DNA, 46 bp, Artificial Sequence
  Synthesized adaptor oligonucleotide
  misc_feature (34)..(36): n is a, c, g, or t
tgcaggaccagagaattcgaatacaagactaccnnnacgtatgcca

SEQ ID NO: 6063 - DNA, 46 bp, Artificial Sequence
  Synthesized adaptor oligonucleotide
  misc_feature (34)..(36): n is a, c, g, or t
tgcaggaccagagaattcgaatacacttagacgnnnacgtatgcca

SEQ ID NO: 6064 - DNA, 46 bp, Artificial Sequence
  Synthesized adaptor oligonucleotide
  misc_feature (34)..(36): n is a, c, g, or t
tgcaggaccagagaattcgaatacacggcggccnnnacgtatgcca

SEQ ID NO: 6065 - DNA, 46 bp, Artificial Sequence
  Synthesized adaptor oligonucleotide
  misc_feature (34)..(36): n is a, c, g, or t
tgcaggaccagagaattcgaatacagccgatatnnnacgtatgcca

SEQ ID NO: 6066 - DNA, 46 bp, Artificial Sequence
  Synthesized adaptor oligonucleotide
  misc_feature (34)..(36): n is a, c, g, or t
tgcaggaccagagaattcgaatacacccggcccnnnacgtatgcca

SEQ ID NO: 6067 - DNA, 46 bp, Artificial Sequence
  Synthesized adaptor oligonucleotide
  misc_feature (34)..(36): n is a, c, g, or t
tgcaggaccagagaattcgaatacacctcgctgnnnacgtatgcca

SEQ ID NO: 6068 - DNA, 46 bp, Artificial Sequence
  Synthesized adaptor oligonucleotide
  misc_feature (34)..(36): n is a, c, g, or t
tgcaggaccagagaattcgaatacacagccatannnacgtatgcca

SEQ ID NO: 6069 - DNA, 46 bp, Artificial Sequence
  Synthesized adaptor oligonucleotide
  misc_feature (34)..(36): n is a, c, g, or t
tgcaggaccagagaattcgaatacaaatggagcnnnctagcgttac

SEQ ID NO: 6070 - DNA, 46 bp, Artificial Sequence
  Synthesized adaptor oligonucleotide
  misc_feature (34)..(36): n is a, c, g, or t
tgcaggaccagagaattcgaatacatcacagacnnnctagcgttac

SEQ ID NO: 6071 - DNA, 46 bp, Artificial Sequence
  Synthesized adaptor oligonucleotide
  misc_feature (34)..(36): n is a, c, g, or t
tgcaggaccagagaattcgaatacatccgtccgnnnctagcgttac

SEQ ID NO: 6072 - DNA, 46 bp, Artificial Sequence
  Synthesized adaptor oligonucleotide
  misc_feature (34)..(36): n is a, c, g, or t
tgcaggaccagagaattcgaatacagaatggacnnnctagcgttac

SEQ ID NO: 6073 - DNA, 46 bp, Artificial Sequence
  Synthesized adaptor oligonucleotide
  misc_feature (34)..(36): n is a, c, g, or t
tgcaggaccagagaattcgaatacagtgctcaannnctagcgttac

SEQ ID NO: 6074 - DNA, 46 bp, Artificial Sequence
  Synthesized adaptor oligonucleotide
  misc_feature (34)..(36): n is a, c, g, or t
tgcaggaccagagaattcgaatacatgttcggannnctagcgttac

SEQ ID NO: 6075 - DNA, 46 bp, Artificial Sequence
  Synthesized adaptor oligonucleotide
  misc_feature (34)..(36): n is a, c, g, or t
tgcaggaccagagaattcgaatacactgcgtggnnnctagcgttac

SEQ ID NO: 6076 - DNA, 46 bp, Artificial Sequence
  Synthesized adaptor oligonucleotide
  misc_feature (34)..(36): n is a, c, g, or t
tgcaggaccagagaattcgaatacaaccgtcaannnctagcgttac

SEQ ID NO: 6077 - DNA, 46 bp, Artificial Sequence
  Synthesized adaptor oligonucleotide
  misc_feature (34)..(36): n is a, c, g, or t
tgcaggaccagagaattcgaatacaggtaacgannnctagcgttac

SEQ ID NO: 6078 - DNA, 46 bp, Artificial Sequence
  Synthesized adaptor oligonucleotide
  misc_feature (34)..(36): n is a, c, g, or t
tgcaggaccagagaattcgaatacaatccgagtnnnctagcgttac

SEQ ID NO: 6079 - DNA, 46 bp, Artificial Sequence
  Synthesized adaptor oligonucleotide
  misc_feature (34)..(36): n is a, c, g, or t
tgcaggaccagagaattcgaatacaaccaaccannnctagcgttac

SEQ ID NO: 6080 - DNA, 46 bp, Artificial Sequence
  Synthesized adaptor oligonucleotide
  misc_feature (34)..(36): n is a, c, g, or t
tgcaggaccagagaattcgaatacacagtatatnnnctagcgttac

SEQ ID NO: 6081 - DNA, 46 bp, Artificial Sequence
  Synthesized adaptor oligonucleotide
  misc_feature (34)..(36): n is a, c, g, or t
tgcaggaccagagaattcgaatacatccgatagnnnctagcgttac

SEQ ID NO: 6082 - DNA, 46 bp, Artificial Sequence
  Synthesized adaptor oligonucleotide
  misc_feature (34)..(36): n is a, c, g, or t
tgcaggaccagagaattcgaatacattagtatgnnnctagcgttac

SEQ ID NO: 6083 - DNA, 46 bp, Artificial Sequence
  Synthesized adaptor oligonucleotide
  misc_feature (34)..(36): n is a, c, g, or t
tgcaggaccagagaattcgaatacaacattcaannnctagcgttac

SEQ ID NO: 6084 - DNA, 46 bp, Artificial Sequence
  Synthesized adaptor oligonucleotide
  misc_feature (34)..(36): n is a, c, g, or t
tgcaggaccagagaattcgaatacagtactgacnnnctagcgttac

SEQ ID NO: 6085 - DNA, 46 bp, Artificial Sequence
  Synthesized adaptor oligonucleotide
  misc_feature (34)..(36): n is a, c, g, or t
tgcaggaccagagaattcgaatacacctcattgnnnctagcgttac

SEQ ID NO: 6086 - DNA, 46 bp, Artificial Sequence
  Synthesized adaptor oligonucleotide
  misc_feature (34)..(36): n is a, c, g, or t
tgcaggaccagagaattcgaatacaatggcactnnnctagcgttac

SEQ ID NO: 6087 - DNA, 46 bp, Artificial Sequence
  Synthesized adaptor oligonucleotide
  misc_feature (34)..(36): n is a, c, g, or t
tgcaggaccagagaattcgaatacaccccacgtnnnctagcgttac

SEQ ID NO: 6088 - DNA, 46 bp, Artificial Sequence
  Synthesized adaptor oligonucleotide
  misc_feature (34)..(36): n is a, c, g, or t
tgcaggaccagagaattcgaatacacaaacctgnnnctagcgttac

SEQ ID NO: 6089 - DNA, 46 bp, Artificial Sequence
  Synthesized adaptor oligonucleotide
  misc_feature (34)..(36): n is a, c, g, or t
tgcaggaccagagaattcgaatacacggccagtnnnctagcgttac

SEQ ID NO: 6090 - DNA, 46 bp, Artificial Sequence
  Synthesized adaptor oligonucleotide
  misc_feature (34)..(36): n is a, c, g, or t
tgcaggaccagagaattcgaatacagacaacctnnnctagcgttac

SEQ ID NO: 6091 - DNA, 46 bp, Artificial Sequence
  Synthesized adaptor oligonucleotide
  misc_feature (34)..(36): n is a, c, g, or t
tgcaggaccagagaattcgaatacatggcacatnnnctagcgttac

SEQ ID NO: 6092 - DNA, 46 bp, Artificial Sequence
  Synthesized adaptor oligonucleotide
  misc_feature (34)..(36): n is a, c, g, or t
tgcaggaccagagaattcgaatacaccaagtacnnnctagcgttac

SEQ ID NO: 6093 - DNA, 46 bp, Artificial Sequence
  Synthesized adaptor oligonucleotide
  misc_feature (34)..(36): n is a, c, g, or t
tgcaggaccagagaattcgaatacacacgaccgnnnctagcgttac

SEQ ID NO: 6094 - DNA, 46 bp, Artificial Sequence
  Synthesized adaptor oligonucleotide
  misc_feature (34)..(36): n is a, c, g, or t
tgcaggaccagagaattcgaatacaccgtgatannnctagcgttac

SEQ ID NO: 6095 - DNA, 46 bp, Artificial Sequence
  Synthesized adaptor oligonucleotide
  misc_feature (34)..(36): n is a, c, g, or t
tgcaggaccagagaattcgaatacacattgcctnnnctagcgttac

SEQ ID NO: 6096 - DNA, 46 bp, Artificial Sequence
  Synthesized adaptor oligonucleotide
  misc_feature (34)..(36): n is a, c, g, or t
tgcaggaccagagaattcgaatacatgttgtttnnnctagcgttac

SEQ ID NO: 6097 - DNA, 46 bp, Artificial Sequence
  Synthesized adaptor oligonucleotide
  misc_feature (34)..(36): n is a, c, g, or t
tgcaggaccagagaattcgaatacatgtttttgnnnctagcgttac

SEQ ID NO: 6098 - DNA, 46 bp, Artificial Sequence
  Synthesized adaptor oligonucleotide
  misc_feature (34)..(36): n is a, c, g, or t
tgcaggaccagagaattcgaatacagctcctcgnnnctagcgttac

SEQ ID NO: 6099 - DNA, 46 bp, Artificial Sequence
  Synthesized adaptor oligonucleotide
  misc_feature (34)..(36): n is a, c, g, or t
tgcaggaccagagaattcgaatacaccacctgcnnnctagcgttac

SEQ ID NO: 6100 - DNA, 46 bp, Artificial Sequence
  Synthesized adaptor oligonucleotide
  misc_feature (34)..(36): n is a, c, g, or t
tgcaggaccagagaattcgaatacagagcggtgnnnctagcgttac

SEQ ID NO: 6101 - DNA, 46 bp, Artificial Sequence
  Synthesized adaptor oligonucleotide
  misc_feature (34)..(36): n is a, c, g, or t
tgcaggaccagagaattcgaatacaaacaacggnnnctagcgttac

SEQ ID NO: 6102 - DNA, 46 bp, Artificial Sequence
  Synthesized adaptor oligonucleotide
  misc_feature (34)..(36): n is a, c, g, or t
tgcaggaccagagaattcgaatacaattgctttnnnctagcgttac

SEQ ID NO: 6103 - DNA, 46 bp, Artificial Sequence
  Synthesized adaptor oligonucleotide
  misc_feature (34)..(36): n is a, c, g, or t
tgcaggaccagagaattcgaatacaccagagaannnctagcgttac

SEQ ID NO: 6104 - DNA, 46 bp, Artificial Sequence
  Synthesized adaptor oligonucleotide
  misc_feature (34)..(36): n is a, c, g, or t
tgcaggaccagagaattcgaatacagatacctgnnnctagcgttac

SEQ ID NO: 6105 - DNA, 46 bp, Artificial Sequence
  Synthesized adaptor oligonucleotide
  misc_feature (34)..(36): n is a, c, g, or t
tgcaggaccagagaattcgaatacaacttattcnnnctagcgttac

SEQ ID NO: 6106 - DNA, 46 bp, Artificial Sequence
  Synthesized adaptor oligonucleotide
  misc_feature (34)..(36): n is a, c, g, or t
tgcaggaccagagaattcgaatacaagttgttannnctagcgttac

SEQ ID NO: 6107 - DNA, 46 bp, Artificial Sequence
  Synthesized adaptor oligonucleotide
  misc_feature (34)..(36): n is a, c, g, or t
tgcaggaccagagaattcgaatacaatgactgcnnnctagcgttac

SEQ ID NO: 6108 - DNA, 46 bp, Artificial Sequence
  Synthesized adaptor oligonucleotide
  misc_feature (34)..(36): n is a, c, g, or t
tgcaggaccagagaattcgaatacaagcaaacgnnnctagcgttac

SEQ ID NO: 6109 - DNA, 46 bp, Artificial Sequence
  Synthesized adaptor oligonucleotide
  misc_feature (34)..(36): n is a, c, g, or t
tgcaggaccagagaattcgaatacaagactattnnnctagcgttac

SEQ ID NO: 6110 - DNA, 46 bp, Artificial Sequence
  Synthesized adaptor oligonucleotide
  misc_feature (34)..(36): n is a, c, g, or t
tgcaggaccagagaattcgaatacactgaaaccnnnctagcgttac

SEQ ID NO: 6111 - DNA, 46 bp, Artificial Sequence
  Synthesized adaptor oligonucleotide
  misc_feature (34)..(36): n is a, c, g, or t
tgcaggaccagagaattcgaatacaaggaaaggnnnctagcgttac

SEQ ID NO: 6112 - DNA, 46 bp, Artificial Sequence
  Synthesized adaptor oligonucleotide
  misc_feature (34)..(36): n is a, c, g, or t
tgcaggaccagagaattcgaatacaccctagttnnnctagcgttac

SEQ ID NO: 6113 - DNA, 46 bp, Artificial Sequence
  Synthesized adaptor oligonucleotide
  misc_feature (34)..(36): n is a, c, g, or t
tgcaggaccagagaattcgaatacacaaaccacnnnctagcgttac

SEQ ID NO: 6114 - DNA, 46 bp, Artificial Sequence
  Synthesized adaptor oligonucleotide
  misc_feature (34)..(36): n is a, c, g, or t
tgcaggaccagagaattcgaatacattgtagtannnctagcgttac

SEQ ID NO: 6115 - DNA, 46 bp, Artificial Sequence
  Synthesized adaptor oligonucleotide
  misc_feature (34)..(36): n is a, c, g, or t
tgcaggaccagagaattcgaatacagtacagctnnnctagcgttac

SEQ ID NO: 6116 - DNA, 46 bp, Artificial Sequence
  Synthesized adaptor oligonucleotide
  misc_feature (34)..(36): n is a, c, g, or t
tgcaggaccagagaattcgaatacaagtgtaccnnnctagcgttac

SEQ ID NO: 6117 - DNA, 46 bp, Artificial Sequence
  Synthesized adaptor oligonucleotide
  misc_feature (34)..(36): n is a, c, g, or t
tgcaggaccagagaattcgaatacattttatgcnnnctagcgttac

SEQ ID NO: 6118 - DNA, 46 bp, Artificial Sequence
  Synthesized adaptor oligonucleotide
  misc_feature (34)..(36): n is a, c, g, or t
tgcaggaccagagaattcgaatacaaatccgtgnnnctagcgttac

SEQ ID NO: 6119 - DNA, 46 bp, Artificial Sequence
  Synthesized adaptor oligonucleotide
  misc_feature (34)..(36): n is a, c, g, or t
tgcaggaccagagaattcgaatacacgatctgannnctagcgttac

SEQ ID NO: 6120 - DNA, 46 bp, Artificial Sequence
  Synthesized adaptor oligonucleotide
  misc_feature (34)..(36): n is a, c, g, or t
tgcaggaccagagaattcgaatacagatagatannnctagcgttac

SEQ ID NO: 6121 - DNA, 46 bp, Artificial Sequence
  Synthesized adaptor oligonucleotide
  misc_feature (34)..(36): n is a, c, g, or t
tgcaggaccagagaattcgaatacagagtcctannnctagcgttac

SEQ ID NO: 6122 - DNA, 46 bp, Artificial Sequence
  Synthesized adaptor oligonucleotide
  misc_feature (34)..(36): n is a, c, g, or t
tgcaggaccagagaattcgaatacacatgtggtnnnctagcgttac

SEQ ID NO: 6123 - DNA, 46 bp, Artificial Sequence
  Synthesized adaptor oligonucleotide
  misc_feature (34)..(36): n is a, c, g, or t
tgcaggaccagagaattcgaatacagatcgcgcnnnctagcgttac

SEQ ID NO: 6124 - DNA, 46 bp, Artificial Sequence
  Synthesized adaptor oligonucleotide
  misc_feature (34)..(36): n is a, c, g, or t
tgcaggaccagagaattcgaatacaaccacatgnnnctagcgttac

SEQ ID NO: 6125 - DNA, 46 bp, Artificial Sequence
  Synthesized adaptor oligonucleotide
  misc_feature (34)..(36): n is a, c, g, or t
tgcaggaccagagaattcgaatacatgccgatannnctagcgttac

SEQ ID NO: 6126 - DNA, 46 bp, Artificial Sequence
  Synthesized adaptor oligonucleotide
  misc_feature (34)..(36): n is a, c, g, or t
tgcaggaccagagaattcgaatacacaaagcctnnnctagcgttac

SEQ ID NO: 6127 - DNA, 46 bp, Artificial Sequence
  Synthesized adaptor oligonucleotide
  misc_feature (34)..(36): n is a, c, g, or t
tgcaggaccagagaattcgaatacaactgacgtnnnctagcgttac

SEQ ID NO: 6128 - DNA, 46 bp, Artificial Sequence
  Synthesized adaptor oligonucleotide
  misc_feature (34)..(36): n is a, c, g, or t
tgcaggaccagagaattcgaatacaaagctcgtnnnctagcgttac

SEQ ID NO: 6129 - DNA, 46 bp, Artificial Sequence
  Synthesized adaptor oligonucleotide
  misc_feature (34)..(36): n is a, c, g, or t
tgcaggaccagagaattcgaatacaggatcgaannngatcgacatg

SEQ ID NO: 6130 - DNA, 46 bp, Artificial Sequence
  Synthesized adaptor oligonucleotide
  misc_feature (34)..(36): n is a, c, g, or t
tgcaggaccagagaattcgaatacatcgcaacannngatcgacatg

SEQ ID NO: 6131 - DNA, 46 bp, Artificial Sequence
  Synthesized adaptor oligonucleotide
  misc_feature (34)..(36): n is a, c, g, or t
tgcaggaccagagaattcgaatacaccgactaannngatcgacatg

SEQ ID NO: 6132 - DNA, 46 bp, Artificial Sequence
  Synthesized adaptor oligonucleotide
  misc_feature (34)..(36): n is a, c, g, or t
tgcaggaccagagaattcgaatacagaccgttannngatcgacatg

SEQ ID NO: 6133 - DNA, 46 bp, Artificial Sequence
  Synthesized adaptor oligonucleotide
  misc_feature (34)..(36): n is a, c, g, or t
tgcaggaccagagaattcgaatacaatgcccttnnngatcgacatg

SEQ ID NO: 6134 - DNA, 46 bp, Artificial Sequence
  Synthesized adaptor oligonucleotide
  misc_feature (34)..(36): n is a, c, g, or t
tgcaggaccagagaattcgaatacatcgaaaccnnngatcgacatg

SEQ ID NO: 6135 - DNA, 46 bp, Artificial Sequence
  Synthesized adaptor oligonucleotide
  misc_feature (34)..(36): n is a, c, g, or t
tgcaggaccagagaattcgaatacagaccttctnnngatcgacatg

SEQ ID NO: 6136 - DNA, 46 bp, Artificial Sequence
  Synthesized adaptor oligonucleotide
  misc_feature (34)..(36): n is a, c, g, or t
tgcaggaccagagaattcgaatacactaccctannngatcgacatg

SEQ ID NO: 6137 - DNA, 46 bp, Artificial Sequence
  Synthesized adaptor oligonucleotide
  misc_feature (34)..(36): n is a, c, g, or t
tgcaggaccagagaattcgaatacaatgccttcnnngatcgacatg

SEQ ID NO: 6138 - DNA, 46 bp, Artificial Sequence
  Synthesized adaptor oligonucleotide
  misc_feature (34)..(36): n is a, c, g, or t
tgcaggaccagagaattcgaatacagcgactatnnngatcgacatg

SEQ ID NO: 6139 - DNA, 46 bp, Artificial Sequence
  Synthesized adaptor oligonucleotide
  misc_feature (34)..(36): n is a, c, g, or t
tgcaggaccagagaattcgaatacaggcattcannngatcgacatg

SEQ ID NO: 6140 - DNA, 46 bp, Artificial Sequence
  Synthesized adaptor oligonucleotide
  misc_feature (34)..(36): n is a, c, g, or t
tgcaggaccagagaattcgaatacagctagaagnnngatcgacatg

SEQ ID NO: 6141 - DNA, 46 bp, Artificial Sequence
  Synthesized adaptor oligonucleotide
  misc_feature (34)..(36): n is a, c, g, or t
tgcaggaccagagaattcgaatacatttataaannngatcgacatg

SEQ ID NO: 6142 - DNA, 46 bp, Artificial Sequence
  Synthesized adaptor oligonucleotide
  misc_feature (34)..(36): n is a, c, g, or t
tgcaggaccagagaattcgaatacatccctacannngatcgacatg

SEQ ID NO: 6143 - DNA, 46 bp, Artificial Sequence
  Synthesized adaptor oligonucleotide
  misc_feature (34)..(36): n is a, c, g, or t
tgcaggaccagagaattcgaatacaacgtctagnnngatcgacatg

SEQ ID NO: 6144 - DNA, 46 bp, Artificial Sequence
  Synthesized adaptor oligonucleotide
  misc_feature (34)..(36): n is a, c, g, or t
tgcaggaccagagaattcgaatacagagctttgnnngatcgacatg

SEQ ID NO: 6145 - DNA, 46 bp, Artificial Sequence
  Synthesized adaptor oligonucleotide
  misc_feature (34)..(36): n is a, c, g, or t
tgcaggaccagagaattcgaatacaagagcggcnnngatcgacatg

SEQ ID NO: 6146 - DNA, 46 bp, Artificial Sequence
  Synthesized adaptor oligonucleotide
  misc_feature (34)..(36): n is a, c, g, or t
tgcaggaccagagaattcgaatacacatatacannngatcgacatg

SEQ ID NO: 6147 - DNA, 46 bp, Artificial Sequence
  Synthesized adaptor oligonucleotide
  misc_feature (34)..(36): n is a, c, g, or t
tgcaggaccagagaattcgaatacaaaggctagnnngatcgacatg

SEQ ID NO: 6148 - DNA, 46 bp, Artificial Sequence
  Synthesized adaptor oligonucleotide
  misc_feature (34)..(36): n is a, c, g, or t
tgcaggaccagagaattcgaatacatatcgacgnnngatcgacatg

SEQ ID NO: 6149 - DNA, 46 bp, Artificial Sequence
  Synthesized adaptor oligonucleotide
  misc_feature (34)..(36): n is a, c, g, or t
tgcaggaccagagaattcgaatacaagacgtctnnngatcgacatg

SEQ ID NO: 6150 - DNA, 46 bp, Artificial Sequence
  Synthesized adaptor oligonucleotide
  misc_feature (34)..(36): n is a, c, g, or t
tgcaggaccagagaattcgaatacatgttacccnnngatcgacatg

SEQ ID NO: 6151 - DNA, 46 bp, Artificial Sequence
  Synthesized adaptor oligonucleotide
  misc_feature (34)..(36): n is a, c, g, or t
tgcaggaccagagaattcgaatacagcctgcagnnngatcgacatg

SEQ ID NO: 6152 - DNA, 46 bp, Artificial Sequence
  Synthesized adaptor oligonucleotide
  misc_feature (34)..(36): n is a, c, g, or t
tgcaggaccagagaattcgaatacacgtaacgtnnngatcgacatg

SEQ ID NO: 6153 - DNA, 46 bp, Artificial Sequence
  Synthesized adaptor oligonucleotide
  misc_feature (34)..(36): n is a, c, g, or t
tgcaggaccagagaattcgaatacaatcttatcnnngatcgacatg

SEQ ID NO: 6154 - DNA, 46 bp, Artificial Sequence
  Synthesized adaptor oligonucleotide
  misc_feature (34)..(36): n is a, c, g, or t
tgcaggaccagagaattcgaatacaacgtttggnnngatcgacatg

SEQ ID NO: 6155 - DNA, 46 bp, Artificial Sequence
  Synthesized adaptor oligonucleotide
  misc_feature (34)..(36): n is a, c, g, or t
tgcaggaccagagaattcgaatacagattaaagnnngatcgacatg

SEQ ID NO: 6156 - DNA, 46 bp, Artificial Sequence
  Synthesized adaptor oligonucleotide
  misc_feature (34)..(36): n is a, c, g, or t
tgcaggaccagagaattcgaatacattgccagannngatcgacatg

SEQ ID NO: 6157 - DNA, 46 bp, Artificial Sequence
  Synthesized adaptor oligonucleotide
  misc_feature (34)..(36): n is a, c, g, or t
tgcaggaccagagaattcgaatacacggcatatnnngatcgacatg

SEQ ID NO: 6158 - DNA, 46 bp, Artificial Sequence
  Synthesized adaptor oligonucleotide
  misc_feature (34)..(36): n is a, c, g, or t
tgcaggaccagagaattcgaatacaggtcagccnnngatcgacatg

SEQ ID NO: 6159 - DNA, 46 bp, Artificial Sequence
  Synthesized adaptor oligonucleotide
  misc_feature (34)..(36): n is a, c, g, or t
tgcaggaccagagaattcgaatacactaccactnnngatcgacatg

SEQ ID NO: 6160 - DNA, 46 bp, Artificial Sequence
  Synthesized adaptor oligonucleotide
  misc_feature (34)..(36): n is a, c, g, or t
tgcaggaccagagaattcgaatacacgcacggtnnngatcgacatg

SEQ ID NO: 6161 - DNA, 46 bp, Artificial Sequence
  Synthesized adaptor oligonucleotide
  misc_feature (34)..(36): n is a, c, g, or t
tgcaggaccagagaattcgaatacatgcttcgtnnngatcgacatg

SEQ ID NO: 6162 - DNA, 46 bp, Artificial Sequence
  Synthesized adaptor oligonucleotide
  misc_feature (34)..(36): n is a, c, g, or t
tgcaggaccagagaattcgaatacaagcactgtnnngatcgacatg

SEQ ID NO: 6163 - DNA, 46 bp, Artificial Sequence
  Synthesized adaptor oligonucleotide
  misc_feature (34)..(36): n is a, c, g, or t
tgcaggaccagagaattcgaatacacttacaaannngatcgacatg

SEQ ID NO: 6164 - DNA, 46 bp, Artificial Sequence
  Synthesized adaptor oligonucleotide
  misc_feature (34)..(36): n is a, c, g, or t
tgcaggaccagagaattcgaatacacgatggccnnngatcgacatg

SEQ ID NO: 6165 - DNA, 46 bp, Artificial Sequence
  Synthesized adaptor oligonucleotide
  misc_feature (34)..(36): n is a, c, g, or t
tgcaggaccagagaattcgaatacacaccggcannngatcgacatg

SEQ ID NO: 6166 - DNA, 46 bp, Artificial Sequence
  Synthesized adaptor oligonucleotide
  misc_feature (34)..(36): n is a, c, g, or t
tgcaggaccagagaattcgaatacagccataacnnngatcgacatg

SEQ ID NO: 6167 - DNA, 46 bp, Artificial Sequence
  Synthesized adaptor oligonucleotide
  misc_feature (34)..(36): n is a, c, g, or t
tgcaggaccagagaattcgaatacatgaagtccnnngatcgacatg

SEQ ID NO: 6168 - DNA, 46 bp, Artificial Sequence
  Synthesized adaptor oligonucleotide
  misc_feature (34)..(36): n is a, c, g, or t
tgcaggaccagagaattcgaatacagcaacactnnngatcgacatg

SEQ ID NO: 6169 - DNA, 46 bp, Artificial Sequence
  Synthesized adaptor oligonucleotide
  misc_feature (34)..(36): n is a, c, g, or t
tgcaggaccagagaattcgaatacaacgcttctnnngatcgacatg

SEQ ID NO: 6170 - DNA, 46 bp, Artificial Sequence
  Synthesized adaptor oligonucleotide
  misc_feature (34)..(36): n is a, c, g, or t
tgcaggaccagagaattcgaatacataccggcgnnngatcgacatg

SEQ ID NO: 6171 - DNA, 46 bp, Artificial Sequence
  Synthesized adaptor oligonucleotide
  misc_feature (34)..(36): n is a, c, g, or t
tgcaggaccagagaattcgaatacatgctaatannngatcgacatg

SEQ ID NO: 6172 - DNA, 46 bp, Artificial Sequence
  Synthesized adaptor oligonucleotide
  misc_feature (34)..(36): n is a, c, g, or t
tgcaggaccagagaattcgaatacataaggagcnnngatcgacatg

SEQ ID NO: 6173 - DNA, 46 bp, Artificial Sequence
  Synthesized adaptor oligonucleotide
  misc_feature (34)..(36): n is a, c, g, or t
tgcaggaccagagaattcgaatacatagtccgannngatcgacatg

SEQ ID NO: 6174 - DNA, 46 bp, Artificial Sequence
  Synthesized adaptor oligonucleotide
  misc_feature (34)..(36): n is a, c, g, or t
tgcaggaccagagaattcgaatacactatcctgnnngatcgacatg

SEQ ID NO: 6175 - DNA, 46 bp, Artificial Sequence
  Synthesized adaptor oligonucleotide
  misc_feature (34)..(36): n is a, c, g, or t
tgcaggaccagagaattcgaatacatttggtccnnngatcgacatg

SEQ ID NO: 6176 - DNA, 46 bp, Artificial Sequence
  Synthesized adaptor oligonucleotide
  misc_feature (34)..(36): n is a, c, g, or t
tgcaggaccagagaattcgaatacagcctttcannngatcgacatg

SEQ ID NO: 6177 - DNA, 46 bp, Artificial Sequence
  Synthesized adaptor oligonucleotide
  misc_feature (34)..(36): n is a, c, g, or t
tgcaggaccagagaattcgaatacagtgttcgannngatcgacatg

SEQ ID NO: 6178 - DNA, 46 bp, Artificial Sequence
  Synthesized adaptor oligonucleotide
  misc_feature (34)..(36): n is a, c, g, or t
tgcaggaccagagaattcgaatacaactgtcagnnngatcgacatg

SEQ ID NO: 6179 - DNA, 46 bp, Artificial Sequence
  Synthesized adaptor oligonucleotide
  misc_feature (34)..(36): n is a, c, g, or t
tgcaggaccagagaattcgaatacaatctgacgnnngatcgacatg

SEQ ID NO: 6180 - DNA, 46 bp, Artificial Sequence
  Synthesized adaptor oligonucleotide
  misc_feature (34)..(36): n is a, c, g, or t
tgcaggaccagagaattcgaatacatacctcgtnnngatcgacatg

SEQ ID NO: 6181 - DNA, 46 bp, Artificial Sequence
  Synthesized adaptor oligonucleotide
  misc_feature (34)..(36): n is a, c, g, or t
tgcaggaccagagaattcgaatacatgcatacgnnngatcgacatg

SEQ ID NO: 6182 - DNA, 46 bp, Artificial Sequence
  Synthesized adaptor oligonucleotide
  misc_feature (34)..(36): n is a, c, g, or t
tgcaggaccagagaattcgaatacacaggtaagnnngatcgacatg

SEQ ID NO: 6183 - DNA, 46 bp, Artificial Sequence
  Synthesized adaptor oligonucleotide
  misc_feature (34)..(36): n is a, c, g, or t
tgcaggaccagagaattcgaatacaggaccaaannngatcgacatg

SEQ ID NO: 6184 - DNA, 46 bp, Artificial Sequence
  Synthesized adaptor oligonucleotide
  misc_feature (34)..(36): n is a, c, g, or t
tgcaggaccagagaattcgaatacaggtcgccannngatcgacatg

SEQ ID NO: 6185 - DNA, 46 bp, Artificial Sequence
  Synthesized adaptor oligonucleotide
  misc_feature (34)..(36): n is a, c, g, or t
tgcaggaccagagaattcgaatacaatggaagcnnngatcgacatg

SEQ ID NO: 6186 - DNA, 46 bp, Artificial Sequence
  Synthesized adaptor oligonucleotide
  misc_feature (34)..(36): n is a, c, g, or t
tgcaggaccagagaattcgaatacacatacgacnnngatcgacatg

SEQ ID NO: 6187 - DNA, 46 bp, Artificial Sequence
  Synthesized adaptor oligonucleotide
  misc_feature (34)..(36): n is a, c, g, or t
tgcaggaccagagaattcgaatacattcagcgannngatcgacatg

SEQ ID NO: 6188 - DNA, 46 bp, Artificial Sequence
  Synthesized adaptor oligonucleotide
  misc_feature (34)..(36): n is a, c, g, or t
tgcaggaccagagaattcgaatacactgcggtgnnngatcgacatg

SEQ ID NO: 6189 - DNA, 46 bp, Artificial Sequence
  Synthesized adaptor oligonucleotide
  misc_feature (34)..(36): n is a, c, g, or t
tgcaggaccagagaattcgaatacacagtactgnnntgcatcaggt

SEQ ID NO: 6190 - DNA, 46 bp, Artificial Sequence
  Synthesized adaptor oligonucleotide
  misc_feature (34)..(36): n is a, c, g, or t
tgcaggaccagagaattcgaatacagatcgaagnnntgcatcaggt

SEQ ID NO: 6191 - DNA, 46 bp, Artificial Sequence
  Synthesized adaptor oligonucleotide
  misc_feature (34)..(36): n is a, c, g, or t
tgcaggaccagagaattcgaatacatcaaacgcnnntgcatcaggt

SEQ ID NO: 6192 - DNA, 46 bp, Artificial Sequence
  Synthesized adaptor oligonucleotide
  misc_feature (34)..(36): n is a, c, g, or t
tgcaggaccagagaattcgaatacatttcaatcnnntgcatcaggt

SEQ ID NO: 6193 - DNA, 46 bp, Artificial Sequence
  Synthesized adaptor oligonucleotide
  misc_feature (34)..(36): n is a, c, g, or t
tgcaggaccagagaattcgaatacagagatggtnnntgcatcaggt

SEQ ID NO: 6194 - DNA, 46 bp, Artificial Sequence
  Synthesized adaptor oligonucleotide
  misc_feature (34)..(36): n is a, c, g, or t
tgcaggaccagagaattcgaatacaaggctcatnnntgcatcaggt

SEQ ID NO: 6195 - DNA, 46 bp, Artificial Sequence
  Synthesized adaptor oligonucleotide
  misc_feature (34)..(36): n is a, c, g, or t
tgcaggaccagagaattcgaatacatggccgcannntgcatcaggt

SEQ ID NO: 6196 - DNA, 46 bp, Artificial Sequence
  Synthesized adaptor oligonucleotide
  misc_feature (34)..(36): n is a, c, g, or t
tgcaggaccagagaattcgaatacataactgcgnnntgcatcaggt

SEQ ID NO: 6197 - DNA, 46 bp, Artificial Sequence
  Synthesized adaptor oligonucleotide
  misc_feature (34)..(36): n is a, c, g, or t
tgcaggaccagagaattcgaatacaatccttgcnnntgcatcaggt

SEQ ID NO: 6198 - DNA, 46 bp, Artificial Sequence
  Synthesized adaptor oligonucleotide
  misc_feature (34)..(36): n is a, c, g, or t
tgcaggaccagagaattcgaatacaacttaatgnnntgcatcaggt

SEQ ID NO: 6199 - DNA, 46 bp, Artificial Sequence
  Synthesized adaptor oligonucleotide
  misc_feature (34)..(36): n is a, c, g, or t
tgcaggaccagagaattcgaatacacacctgccnnntgcatcaggt

SEQ ID NO: 6200 - DNA, 46 bp, Artificial Sequence
  Synthesized adaptor oligonucleotide
  misc_feature (34)..(36): n is a, c, g, or t
tgcaggaccagagaattcgaatacatatgctttnnntgcatcaggt

SEQ ID NO: 6201 - DNA, 46 bp, Artificial Sequence
  Synthesized adaptor oligonucleotide
  misc_feature (34)..(36): n is a, c, g, or t
tgcaggaccagagaattcgaatacaaggtgcaannntgcatcaggt

SEQ ID NO: 6202 - DNA, 46 bp, Artificial Sequence
  Synthesized adaptor oligonucleotide
  misc_feature (34)..(36): n is a, c, g, or t
tgcaggaccagagaattcgaatacacggctaatnnntgcatcaggt

SEQ ID NO: 6203 - DNA, 46 bp, Artificial Sequence
  Synthesized adaptor oligonucleotide
  misc_feature (34)..(36): n is a, c, g, or t
tgcaggaccagagaattcgaatacatagcaaaannntgcatcaggt

SEQ ID NO: 6204 - DNA, 46 bp, Artificial Sequence
  Synthesized adaptor oligonucleotide
  misc_feature (34)..(36): n is a, c, g, or t
tgcaggaccagagaattcgaatacaagcaagcannntgcatcaggt

SEQ ID NO: 6205 - DNA, 46 bp, Artificial Sequence
  Synthesized adaptor oligonucleotide
  misc_feature (34)..(36): n is a, c, g, or t
tgcaggaccagagaattcgaatacaatagtactnnntgcatcaggt

SEQ ID NO: 6206 - DNA, 46 bp, Artificial Sequence
  Synthesized adaptor oligonucleotide
  misc_feature (34)..(36): n is a, c, g, or t
tgcaggaccagagaattcgaatacacccatgttnnntgcatcaggt

SEQ ID NO: 6207 - DNA, 46 bp, Artificial Sequence
  Synthesized adaptor oligonucleotide
  misc_feature (34)..(36): n is a, c, g, or t
tgcaggaccagagaattcgaatacagagcaatgnnntgcatcaggt

SEQ ID NO: 6208 - DNA, 46 bp, Artificial Sequence
  Synthesized adaptor oligonucleotide
  misc_feature (34)..(36): n is a, c, g, or t
tgcaggaccagagaattcgaatacaaatacctannntgcatcaggt

SEQ ID NO: 6209 - DNA, 46 bp, Artificial Sequence
  Synthesized adaptor oligonucleotide
  misc_feature (34)..(36): n is a, c, g, or t
tgcaggaccagagaattcgaatacaaatattgcnnntgcatcaggt

SEQ ID NO: 6210 - DNA, 46 bp, Artificial Sequence
  Synthesized adaptor oligonucleotide
  misc_feature (34)..(36): n is a, c, g, or t
tgcaggaccagagaattcgaatacaaatccatannntgcatcaggt

SEQ ID NO: 6211 - DNA, 46 bp, Artificial Sequence
  Synthesized adaptor oligonucleotide
  misc_feature (34)..(36): n is a, c, g, or t
tgcaggaccagagaattcgaatacatccatttannntgcatcaggt

SEQ ID NO: 6212 - DNA, 46 bp, Artificial Sequence
  Synthesized adaptor oligonucleotide
  misc_feature (34)..(36): n is a, c, g, or t
tgcaggaccagagaattcgaatacagaggttctnnntgcatcaggt

SEQ ID NO: 6213 - DNA, 46 bp, Artificial Sequence
  Synthesized adaptor oligonucleotide
  misc_feature (34)..(36): n is a, c, g, or t
tgcaggaccagagaattcgaatacagtgataccnnntgcatcaggt

SEQ ID NO: 6214 - DNA, 46 bp, Artificial Sequence
  Synthesized adaptor oligonucleotide
  misc_feature (34)..(36): n is a, c, g, or t
tgcaggaccagagaattcgaatacaaccttgctnnntgcatcaggt

SEQ ID NO: 6215 - DNA, 46 bp, Artificial Sequence
  Synthesized adaptor oligonucleotide
  misc_feature (34)..(36): n is a, c, g, or t
tgcaggaccagagaattcgaatacatatcaagtnnntgcatcaggt

SEQ ID NO: 6216 - DNA, 46 bp, Artificial Sequence
  Synthesized adaptor oligonucleotide
  misc_feature (34)..(36): n is a, c, g, or t
tgcaggaccagagaattcgaatacaacttaggcnnntgcatcaggt

SEQ ID NO: 6217 - DNA, 46 bp, Artificial Sequence
  Synthesized adaptor oligonucleotide
  misc_feature (34)..(36): n is a, c, g, or t
tgcaggaccagagaattcgaatacaactgttccnnntgcatcaggt

SEQ ID NO: 6218 - DNA, 46 bp, Artificial Sequence
  Synthesized adaptor oligonucleotide
  misc_feature (34)..(36): n is a, c, g, or t
tgcaggaccagagaattcgaatacaggatccatnnntgcatcaggt

SEQ ID NO: 6219 - DNA, 46 bp, Artificial Sequence
  Synthesized adaptor oligonucleotide
  misc_feature (34)..(36): n is a, c, g, or t
tgcaggaccagagaattcgaatacaccactccgnnntgcatcaggt

SEQ ID NO: 6220 - DNA, 46 bp, Artificial Sequence
  Synthesized adaptor oligonucleotide
  misc_feature (34)..(36): n is a, c, g, or t
tgcaggaccagagaattcgaatacagcaagagtnnntgcatcaggt

SEQ ID NO: 6221 - DNA, 46 bp, Artificial Sequence
  Synthesized adaptor oligonucleotide
  misc_feature (34)..(36): n is a, c, g, or t
tgcaggaccagagaattcgaatacaaccgtcttnnntgcatcaggt

SEQ ID NO: 6222 - DNA, 46 bp, Artificial Sequence
  Synthesized adaptor oligonucleotide
  misc_feature (34)..(36): n is a, c, g, or t
tgcaggaccagagaattcgaatacaggcttagtnnntgcatcaggt

SEQ ID NO: 6223 - DNA, 46 bp, Artificial Sequence
  Synthesized adaptor oligonucleotide
  misc_feature (34)..(36): n is a, c, g, or t
tgcaggaccagagaattcgaatacacctaagcannntgcatcaggt

SEQ ID NO: 6224 - DNA, 46 bp, Artificial Sequence
  Synthesized adaptor oligonucleotide
  misc_feature (34)..(36): n is a, c, g, or t
tgcaggaccagagaattcgaatacagcgcgaagnnntgcatcaggt

SEQ ID NO: 6225 - DNA, 46 bp, Artificial Sequence
  Synthesized adaptor oligonucleotide
  misc_feature (34)..(36): n is a, c, g, or t
tgcaggaccagagaattcgaatacacattcttannntgcatcaggt

SEQ ID NO: 6226 - DNA, 46 bp, Artificial Sequence
  Synthesized adaptor oligonucleotide
  misc_feature (34)..(36): n is a, c, g, or t
tgcaggaccagagaattcgaatacaactacggtnnntgcatcaggt

SEQ ID NO: 6227 - DNA, 46 bp, Artificial Sequence
  Synthesized adaptor oligonucleotide
  misc_feature (34)..(36): n is a, c, g, or t
tgcaggaccagagaattcgaatacaccggagctnnntgcatcaggt

SEQ ID NO: 6228 - DNA, 46 bp, Artificial Sequence
  Synthesized adaptor oligonucleotide
  misc_feature (34)..(36): n is a, c, g, or t
tgcaggaccagagaattcgaatacagtacttaannntgcatcaggt

SEQ ID NO: 6229 - DNA, 46 bp, Artificial Sequence
  Synthesized adaptor oligonucleotide
  misc_feature (34)..(36): n is a, c, g, or t
tgcaggaccagagaattcgaatacatgccgctcnnntgcatcaggt

SEQ ID NO: 6230 - DNA, 46 bp, Artificial Sequence
  Synthesized adaptor oligonucleotide
  misc_feature (34)..(36): n is a, c, g, or t
tgcaggaccagagaattcgaatacagcgacttannntgcatcaggt

SEQ ID NO: 6231 - DNA, 46 bp, Artificial Sequence
  Synthesized adaptor oligonucleotide
  misc_feature (34)..(36): n is a, c, g, or t
tgcaggaccagagaattcgaatacaatggcaagnnntgcatcaggt

SEQ ID NO: 6232 - DNA, 46 bp, Artificial Sequence
  Synthesized adaptor oligonucleotide
  misc_feature (34)..(36): n is a, c, g, or t
tgcaggaccagagaattcgaatacacggaggtgnnntgcatcaggt

SEQ ID NO: 6233 - DNA, 46 bp, Artificial Sequence
  Synthesized adaptor oligonucleotide
  misc_feature (34)..(36): n is a, c, g, or t
tgcaggaccagagaattcgaatacaacattaacnnntgcatcaggt

SEQ ID NO: 6234 - DNA, 46 bp, Artificial Sequence
  Synthesized adaptor oligonucleotide
  misc_feature (34)..(36): n is a, c, g, or t
tgcaggaccagagaattcgaatacataggaaatnnntgcatcaggt

SEQ ID NO: 6235 - DNA, 46 bp, Artificial Sequence
  Synthesized adaptor oligonucleotide
  misc_feature (34)..(36): n is a, c, g, or t
tgcaggaccagagaattcgaatacacctaagtgnnntgcatcaggt

SEQ ID NO: 6236 - DNA, 46 bp, Artificial Sequence
  Synthesized adaptor oligonucleotide
  misc_feature (34)..(36): n is a, c, g, or t
tgcaggaccagagaattcgaatacatagacgctnnntgcatcaggt

SEQ ID NO: 6237 - DNA, 46 bp, Artificial Sequence
  Synthesized adaptor oligonucleotide
  misc_feature (34)..(36): n is a, c, g, or t
tgcaggaccagagaattcgaatacagtgaagcannntgcatcaggt

SEQ ID NO: 6238 - DNA, 46 bp, Artificial Sequence
  Synthesized adaptor oligonucleotide
  misc_feature (34)..(36): n is a, c, g, or t
tgcaggaccagagaattcgaatacaggacgcagnnntgcatcaggt

SEQ ID NO: 6239 - DNA, 46 bp, Artificial Sequence
  Synthesized adaptor oligonucleotide
  misc_feature (34)..(36): n is a, c, g, or t
tgcaggaccagagaattcgaatacattttacgtnnntgcatcaggt

SEQ ID NO: 6240 - DNA, 46 bp, Artificial Sequence
  Synthesized adaptor oligonucleotide
  misc_feature (34)..(36): n is a, c, g, or t
tgcaggaccagagaattcgaatacagatgatttnnntgcatcaggt

SEQ ID NO: 6241 - DNA, 46 bp, Artificial Sequence
  Synthesized adaptor oligonucleotide
  misc_feature (34)..(36): n is a, c, g, or t
tgcaggaccagagaattcgaatacaacggaatgnnntgcatcaggt

SEQ ID NO: 6242 - DNA, 46 bp, Artificial Sequence
  Synthesized adaptor oligonucleotide
  misc_feature (34)..(36): n is a, c, g, or t
tgcaggaccagagaattcgaatacaaatggcagnnntgcatcaggt

SEQ ID NO: 6243 - DNA, 46 bp, Artificial Sequence
  Synthesized adaptor oligonucleotide
  misc_feature (34)..(36): n is a, c, g, or t
tgcaggaccagagaattcgaatacacgactgatnnntgcatcaggt

SEQ ID NO: 6244 - DNA, 46 bp, Artificial Sequence
  Synthesized adaptor oligonucleotide
  misc_feature (34)..(36): n is a, c, g, or t
tgcaggaccagagaattcgaatacaaaagatacnnntgcatcaggt

SEQ ID NO: 6245 - DNA, 46 bp, Artificial Sequence
  Synthesized adaptor oligonucleotide
  misc_feature (34)..(36): n is a, c, g, or t
tgcaggaccagagaattcgaatacaacggcattnnntgcatcaggt

SEQ ID NO: 6246 - DNA, 46 bp, Artificial Sequence
  Synthesized adaptor oligonucleotide
  misc_feature (34)..(36): n is a, c, g, or t
tgcaggaccagagaattcgaatacaccacgctcnnntgcatcaggt

SEQ ID NO: 6247 - DNA, 46 bp, Artificial Sequence
  Synthesized adaptor oligonucleotide
  misc_feature (34)..(36): n is a, c, g, or t
tgcaggaccagagaattcgaatacaaaccactgnnntgcatcaggt

SEQ ID NO: 6248 - DNA, 46 bp, Artificial Sequence
  Synthesized adaptor oligonucleotide
  misc_feature (34)..(36): n is a, c, g, or t
tgcaggaccagagaattcgaatacagtcgagttnnntgcatcaggt

SEQ ID NO: 6249 - DNA, 46 bp, Artificial Sequence
  Synthesized adaptor oligonucleotide
  misc_feature (34)..(36): n is a, c, g, or t
tgcaggaccagagaattcgaatacatgtacgcannnacgtatgcca

SEQ ID NO: 6250 - DNA, 46 bp, Artificial Sequence
  Synthesized adaptor oligonucleotide
  misc_feature (34)..(36): n is a, c, g, or t
tgcaggaccagagaattcgaatacagatgtgtcnnnacgtatgcca

SEQ ID NO: 6251 - DNA, 46 bp, Artificial Sequence
  Synthesized adaptor oligonucleotide
  misc_feature (34)..(36): n is a, c, g, or t
tgcaggaccagagaattcgaatacactagactgnnnacgtatgcca

SEQ ID NO: 6252 - DNA, 46 bp, Artificial Sequence
  Synthesized adaptor oligonucleotide
  misc_feature (34)..(36): n is a, c, g, or t
tgcaggaccagagaattcgaatacagatcgtgtnnnacgtatgcca

SEQ ID NO: 6253 - DNA, 46 bp, Artificial Sequence
  Synthesized adaptor oligonucleotide
  misc_feature (34)..(36): n is a, c, g, or t
tgcaggaccagagaattcgaatacattatctcannnacgtatgcca

SEQ ID NO: 6254 - DNA, 46 bp, Artificial Sequence
  Synthesized adaptor oligonucleotide
  misc_feature (34)..(36): n is a, c, g, or t
tgcaggaccagagaattcgaatacaaaccctagnnnacgtatgcca

SEQ ID NO: 6255 - DNA, 46 bp, Artificial Sequence
  Synthesized adaptor oligonucleotide
  misc_feature (34)..(36): n is a, c, g, or t
tgcaggaccagagaattcgaatacatatcatagnnnacgtatgcca

SEQ ID NO: 6256 - DNA, 46 bp, Artificial Sequence
  Synthesized adaptor oligonucleotide
  misc_feature (34)..(36): n is a, c, g, or t
tgcaggaccagagaattcgaatacacgttcgttnnnacgtatgcca

SEQ ID NO: 6257 - DNA, 46 bp, Artificial Sequence
  Synthesized adaptor oligonucleotide
  misc_feature (34)..(36): n is a, c, g, or t
tgcaggaccagagaattcgaatacaatacaaagnnnacgtatgcca

SEQ ID NO: 6258 - DNA, 46 bp, Artificial Sequence
  Synthesized adaptor oligonucleotide
  misc_feature (34)..(36): n is a, c, g, or t
tgcaggaccagagaattcgaatacagtcctcatnnnacgtatgcca

SEQ ID NO: 6259 - DNA, 46 bp, Artificial Sequence
  Synthesized adaptor oligonucleotide
  misc_feature (34)..(36): n is a, c, g, or t
tgcaggaccagagaattcgaatacaagtagcagnnnacgtatgcca

SEQ ID NO: 6260 - DNA, 46 bp, Artificial Sequence
  Synthesized adaptor oligonucleotide
  misc_feature (34)..(36): n is a, c, g, or t
tgcaggaccagagaattcgaatacagaaaacatnnnacgtatgcca

SEQ ID NO: 6261 - DNA, 46 bp, Artificial Sequence
  Synthesized adaptor oligonucleotide
  misc_feature (34)..(36): n is a, c, g, or t
tgcaggaccagagaattcgaatacattcgcctannnacgtatgcca

SEQ ID NO: 6262 - DNA, 46 bp, Artificial Sequence
  Synthesized adaptor oligonucleotide
  misc_feature (34)..(36): n is a, c, g, or t
tgcaggaccagagaattcgaatacaagagttggnnnacgtatgcca

SEQ ID NO: 6263 - DNA, 46 bp, Artificial Sequence
  Synthesized adaptor oligonucleotide
  misc_feature (34)..(36): n is a, c, g, or t
tgcaggaccagagaattcgaatacacaatattgnnnacgtatgcca

SEQ ID NO: 6264 - DNA, 46 bp, Artificial Sequence
  Synthesized adaptor oligonucleotide
  misc_feature (34)..(36): n is a, c, g, or t
tgcaggaccagagaattcgaatacaaaacctcgnnnacgtatgcca

SEQ ID NO: 6265 - DNA, 46 bp, Artificial Sequence
  Synthesized adaptor oligonucleotide
  misc_feature (34)..(36): n is a, c, g, or t
tgcaggaccagagaattcgaatacaagttaatcnnnacgtatgcca

SEQ ID NO: 6266 - DNA, 46 bp, Artificial Sequence
  Synthesized adaptor oligonucleotide
  misc_feature (34)..(36): n is a, c, g, or t
tgcaggaccagagaattcgaatacagactctagnnnacgtatgcca

SEQ ID NO: 6267 - DNA, 46 bp, Artificial Sequence
  Synthesized adaptor oligonucleotide
  misc_feature (34)..(36): n is a, c, g, or t
tgcaggaccagagaattcgaatacaaggaaaaannnacgtatgcca

SEQ ID NO: 6268 - DNA, 46 bp, Artificial Sequence
  Synthesized adaptor oligonucleotide
  misc_feature (34)..(36): n is a, c, g, or t
tgcaggaccagagaattcgaatacatgactagcnnnacgtatgcca

SEQ ID NO: 6269 - DNA, 46 bp, Artificial Sequence
  Synthesized adaptor oligonucleotide
  misc_feature (34)..(36): n is a, c, g, or t
tgcaggaccagagaattcgaatacacatcgtagnnnacgtatgcca

SEQ ID NO: 6270 - DNA, 46 bp, Artificial Sequence
  Synthesized adaptor oligonucleotide
  misc_feature (34)..(36): n is a, c, g, or t
tgcaggaccagagaattcgaatacaaggtgttcnnnacgtatgcca

SEQ ID NO: 6271 - DNA, 46 bp, Artificial Sequence
  Synthesized adaptor oligonucleotide
  misc_feature (34)..(36): n is a, c, g, or t
tgcaggaccagagaattcgaatacagccattagnnnacgtatgcca

SEQ ID NO: 6272 - DNA, 46 bp, Artificial Sequence
  Synthesized adaptor oligonucleotide
  misc_feature (34)..(36): n is a, c, g, or t
tgcaggaccagagaattcgaatacacgttctgtnnnacgtatgcca

SEQ ID NO: 6273 - DNA, 46 bp, Artificial Sequence
  Synthesized adaptor oligonucleotide
  misc_feature (34)..(36): n is a, c, g, or t
tgcaggaccagagaattcgaatacatccgcctgnnnacgtatgcca

SEQ ID NO: 6274 - DNA, 46 bp, Artificial Sequence
  Synthesized adaptor oligonucleotide
  misc_feature (34)..(36): n is a, c, g, or t
tgcaggaccagagaattcgaatacacctacactnnnacgtatgcca

SEQ ID NO: 6275 - DNA, 46 bp, Artificial Sequence
  Synthesized adaptor oligonucleotide
  misc_feature (34)..(36): n is a, c, g, or t
tgcaggaccagagaattcgaatacaagaagattnnnacgtatgcca

SEQ ID NO: 6276 - DNA, 46 bp, Artificial Sequence
  Synthesized adaptor oligonucleotide
  misc_feature (34)..(36): n is a, c, g, or t
tgcaggaccagagaattcgaatacaagtccttcnnnacgtatgcca

SEQ ID NO: 6277 - DNA, 46 bp, Artificial Sequence
  Synthesized adaptor oligonucleotide
  misc_feature (34)..(36): n is a, c, g, or t
tgcaggaccagagaattcgaatacagcattatannnacgtatgcca

SEQ ID NO: 6278 - DNA, 46 bp, Artificial Sequence
  Synthesized adaptor oligonucleotide
  misc_feature (34)..(36): n is a, c, g, or t
tgcaggaccagagaattcgaatacagtggcattnnnacgtatgcca

SEQ ID NO: 6279 - DNA, 46 bp, Artificial Sequence
  Synthesized adaptor oligonucleotide
  misc_feature (34)..(36): n is a, c, g, or t
tgcaggaccagagaattcgaatacaaacgtcacnnnacgtatgcca

SEQ ID NO: 6280 - DNA, 46 bp, Artificial Sequence
  Synthesized adaptor oligonucleotide
  misc_feature (34)..(36): n is a, c, g, or t
tgcaggaccagagaattcgaatacagttaactannnacgtatgcca

SEQ ID NO: 6281 - DNA, 46 bp, Artificial Sequence
  Synthesized adaptor oligonucleotide
  misc_feature (34)..(36): n is a, c, g, or t
tgcaggaccagagaattcgaatacataaagatgnnnacgtatgcca

SEQ ID NO: 6282 - DNA, 46 bp, Artificial Sequence
  Synthesized adaptor oligonucleotide
  misc_feature (34)..(36): n is a, c, g, or t
tgcaggaccagagaattcgaatacaaatttcctnnnacgtatgcca

SEQ ID NO: 6283 - DNA, 46 bp, Artificial Sequence
  Synthesized adaptor oligonucleotide
  misc_feature (34)..(36): n is a, c, g, or t
tgcaggaccagagaattcgaatacacggcaaaannnacgtatgcca

SEQ ID NO: 6284 - DNA, 46 bp, Artificial Sequence
  Synthesized adaptor oligonucleotide
  misc_feature (34)..(36): n is a, c, g, or t
tgcaggaccagagaattcgaatacatcgcacaannnacgtatgcca

SEQ ID NO: 6285 - DNA, 46 bp, Artificial Sequence
  Synthesized adaptor oligonucleotide
  misc_feature (34)..(36): n is a, c, g, or t
tgcaggaccagagaattcgaatacaaggtcgccnnnacgtatgcca

SEQ ID NO: 6286 - DNA, 46 bp, Artificial Sequence
  Synthesized adaptor oligonucleotide
  misc_feature (34)..(36): n is a, c, g, or t
tgcaggaccagagaattcgaatacaggattcgtnnnacgtatgcca

SEQ ID NO: 6287 - DNA, 46 bp, Artificial Sequence
  Synthesized adaptor oligonucleotide
  misc_feature (34)..(36): n is a, c, g, or t
tgcaggaccagagaattcgaatacaagcatctgnnnacgtatgcca

SEQ ID NO: 6288 - DNA, 46 bp, Artificial Sequence
  Synthesized adaptor oligonucleotide
  misc_feature (34)..(36): n is a, c, g, or t
tgcaggaccagagaattcgaatacacccacaaannnacgtatgcca

SEQ ID NO: 6289 - DNA, 46 bp, Artificial Sequence
  Synthesized adaptor oligonucleotide
  misc_feature (34)..(36): n is a, c, g, or t
tgcaggaccagagaattcgaatacaagttatacnnnacgtatgcca

SEQ ID NO: 6290 - DNA, 46 bp, Artificial Sequence
  Synthesized adaptor oligonucleotide
  misc_feature (34)..(36): n is a, c, g, or t
tgcaggaccagagaattcgaatacatctatcatnnnacgtatgcca

SEQ ID NO: 6291 - DNA, 46 bp, Artificial Sequence
  Synthesized adaptor oligonucleotide
  misc_feature (34)..(36): n is a, c, g, or t
tgcaggaccagagaattcgaatacacggctctcnnnacgtatgcca

SEQ ID NO: 6292 - DNA, 46 bp, Artificial Sequence
  Synthesized adaptor oligonucleotide
  misc_feature (34)..(36): n is a, c, g, or t
tgcaggaccagagaattcgaatacagtgattatnnnacgtatgcca

SEQ ID NO: 6293 - DNA, 46 bp, Artificial Sequence
  Synthesized adaptor oligonucleotide
  misc_feature (34)..(36): n is a, c, g, or t
tgcaggaccagagaattcgaatacatagactcgnnnacgtatgcca

SEQ ID NO: 6294 - DNA, 46 bp, Artificial Sequence
  Synthesized adaptor oligonucleotide
  misc_feature (34)..(36): n is a, c, g, or t
tgcaggaccagagaattcgaatacaaacgtttannnacgtatgcca

SEQ ID NO: 6295 - DNA, 46 bp, Artificial Sequence
  Synthesized adaptor oligonucleotide
  misc_feature (34)..(36): n is a, c, g, or t
tgcaggaccagagaattcgaatacaaagtaagtnnnacgtatgcca

SEQ ID NO: 6296 - DNA, 46 bp, Artificial Sequence
  Synthesized adaptor oligonucleotide
  misc_feature (34)..(36): n is a, c, g, or t
tgcaggaccagagaattcgaatacaatgttaacnnnacgtatgcca

SEQ ID NO: 6297 - DNA, 46 bp, Artificial Sequence
  Synthesized adaptor oligonucleotide
  misc_feature (34)..(36): n is a, c, g, or t
tgcaggaccagagaattcgaatacataatcacannnacgtatgcca

SEQ ID NO: 6298 - DNA, 46 bp, Artificial Sequence
  Synthesized adaptor oligonucleotide
  misc_feature (34)..(36): n is a, c, g, or t
tgcaggaccagagaattcgaatacacatgcttcnnnacgtatgcca

SEQ ID NO: 6299 - DNA, 46 bp, Artificial Sequence
  Synthesized adaptor oligonucleotide
  misc_feature (34)..(36): n is a, c, g, or t
tgcaggaccagagaattcgaatacaagcattatnnnacgtatgcca

SEQ ID NO: 6300 - DNA, 46 bp, Artificial Sequence
  Synthesized adaptor oligonucleotide
  misc_feature (34)..(36): n is a, c, g, or t
tgcaggaccagagaattcgaatacaaggcatagnnnacgtatgcca

SEQ ID NO: 6301 - DNA, 46 bp, Artificial Sequence
  Synthesized adaptor oligonucleotide
  misc_feature (34)..(36): n is a, c, g, or t
tgcaggaccagagaattcgaatacacatacgcannnacgtatgcca

SEQ ID NO: 6302 - DNA, 46 bp, Artificial Sequence
  Synthesized adaptor oligonucleotide
  misc_feature (34)..(36): n is a, c, g, or t
tgcaggaccagagaattcgaatacaagacccgcnnnacgtatgcca

SEQ ID NO: 6303 - DNA, 46 bp, Artificial Sequence
  Synthesized adaptor oligonucleotide
  misc_feature (34)..(36): n is a, c, g, or t
tgcaggaccagagaattcgaatacattccctagnnnacgtatgcca

SEQ ID NO: 6304 - DNA, 46 bp, Artificial Sequence
  Synthesized adaptor oligonucleotide
  misc_feature (34)..(36): n is a, c, g, or t
tgcaggaccagagaattcgaatacaagtgtgctnnnacgtatgcca

SEQ ID NO: 6305 - DNA, 46 bp, Artificial Sequence
  Synthesized adaptor oligonucleotide
  misc_feature (34)..(36): n is a, c, g, or t
tgcaggaccagagaattcgaatacacctgtactnnnacgtatgcca

SEQ ID NO: 6306 - DNA, 46 bp, Artificial Sequence
  Synthesized adaptor oligonucleotide
  misc_feature (34)..(36): n is a, c, g, or t
tgcaggaccagagaattcgaatacacacaccccnnnacgtatgcca

SEQ ID NO: 6307 - DNA, 46 bp, Artificial Sequence
  Synthesized adaptor oligonucleotide
  misc_feature (34)..(36): n is a, c, g, or t
tgcaggaccagagaattcgaatacatttggtggnnnacgtatgcca

SEQ ID NO: 6308 - DNA, 46 bp, Artificial Sequence
  Synthesized adaptor oligonucleotide
  misc_feature (34)..(36): n is a, c, g, or t
tgcaggaccagagaattcgaatacagttagccannnacgtatgcca

SEQ ID NO: 6309 - DNA, 46 bp, Artificial Sequence
  Synthesized adaptor oligonucleotide
  misc_feature (34)..(36): n is a, c, g, or t
tgcaggaccagagaattcgaatacaacgacactnnnctagcgttac

SEQ ID NO: 6310 - DNA, 46 bp, Artificial Sequence
  Synthesized adaptor oligonucleotide
  misc_feature (34)..(36): n is a, c, g, or t
tgcaggaccagagaattcgaatacagcatgactnnnctagcgttac

SEQ ID NO: 6311 - DNA, 46 bp, Artificial Sequence
  Synthesized adaptor oligonucleotide
  misc_feature (34)..(36): n is a, c, g, or t
tgcaggaccagagaattcgaatacatagttgtannnctagcgttac

SEQ ID NO: 6312 - DNA, 46 bp, Artificial Sequence
  Synthesized adaptor oligonucleotide
  misc_feature (34)..(36): n is a, c, g, or t
tgcaggaccagagaattcgaatacacctgttcannnctagcgttac

SEQ ID NO: 6313 - DNA, 46 bp, Artificial Sequence
  Synthesized adaptor oligonucleotide
  misc_feature (34)..(36): n is a, c, g, or t
tgcaggaccagagaattcgaatacactgagtcannnctagcgttac

SEQ ID NO: 6314 - DNA, 46 bp, Artificial Sequence
  Synthesized adaptor oligonucleotide
  misc_feature (34)..(36): n is a, c, g, or t
tgcaggaccagagaattcgaatacatcatcttannnctagcgttac

SEQ ID NO: 6315 - DNA, 46 bp, Artificial Sequence
  Synthesized adaptor oligonucleotide
  misc_feature (34)..(36): n is a, c, g, or t
tgcaggaccagagaattcgaatacacacattttnnnctagcgttac

SEQ ID NO: 6316 - DNA, 46 bp, Artificial Sequence
  Synthesized adaptor oligonucleotide
  misc_feature (34)..(36): n is a, c, g, or t
tgcaggaccagagaattcgaatacagccacatannnctagcgttac

SEQ ID NO: 6317 - DNA, 46 bp, Artificial Sequence
  Synthesized adaptor oligonucleotide
  misc_feature (34)..(36): n is a, c, g, or t
tgcaggaccagagaattcgaatacataaacagannnctagcgttac

SEQ ID NO: 6318 - DNA, 46 bp, Artificial Sequence
  Synthesized adaptor oligonucleotide
  misc_feature (34)..(36): n is a, c, g, or t
tgcaggaccagagaattcgaatacaggtaccatnnnctagcgttac

SEQ ID NO: 6319 - DNA, 46 bp, Artificial Sequence
  Synthesized adaptor oligonucleotide
  misc_feature (34)..(36): n is a, c, g, or t
tgcaggaccagagaattcgaatacaagaaaaagnnnctagcgttac

SEQ ID NO: 6320 - DNA, 46 bp, Artificial Sequence
  Synthesized adaptor oligonucleotide
  misc_feature (34)..(36): n is a, c, g, or t
tgcaggaccagagaattcgaatacagctctcatnnnctagcgttac

SEQ ID NO: 6321 - DNA, 46 bp, Artificial Sequence
  Synthesized adaptor oligonucleotide
  misc_feature (34)..(36): n is a, c, g, or t
tgcaggaccagagaattcgaatacaaggcacaannnctagcgttac

SEQ ID NO: 6322 - DNA, 46 bp, Artificial Sequence
  Synthesized adaptor oligonucleotide
  misc_feature (34)..(36): n is a, c, g, or t
tgcaggaccagagaattcgaatacagcgatgaannnctagcgttac

SEQ ID NO: 6323 - DNA, 46 bp, Artificial Sequence
  Synthesized adaptor oligonucleotide
  misc_feature (34)..(36): n is a, c, g, or t
tgcaggaccagagaattcgaatacatcacttatnnnctagcgttac

SEQ ID NO: 6324 - DNA, 46 bp, Artificial Sequence
  Synthesized adaptor oligonucleotide
  misc_feature (34)..(36): n is a, c, g, or t
tgcaggaccagagaattcgaatacataggccgcnnnctagcgttac

SEQ ID NO: 6325 - DNA, 46 bp, Artificial Sequence
  Synthesized adaptor oligonucleotide
  misc_feature (34)..(36): n is a, c, g, or t
tgcaggaccagagaattcgaatacaatttaaatnnnctagcgttac

SEQ ID NO: 6326 - DNA, 46 bp, Artificial Sequence
  Synthesized adaptor oligonucleotide
  misc_feature (34)..(36): n is a, c, g, or t
tgcaggaccagagaattcgaatacatctgtttannnctagcgttac

SEQ ID NO: 6327 - DNA, 46 bp, Artificial Sequence
  Synthesized adaptor oligonucleotide
  misc_feature (34)..(36): n is a, c, g, or t
tgcaggaccagagaattcgaatacaagttgaaannnctagcgttac

SEQ ID NO: 6328 - DNA, 46 bp, Artificial Sequence
  Synthesized adaptor oligonucleotide
  misc_feature (34)..(36): n is a, c, g, or t
tgcaggaccagagaattcgaatacaatatgactnnnctagcgttac

SEQ ID NO: 6329 - DNA, 46 bp, Artificial Sequence
  Synthesized adaptor oligonucleotide
  misc_feature (34)..(36): n is a, c, g, or t
tgcaggaccagagaattcgaatacagaagactgnnnctagcgttac

SEQ ID NO: 6330 - DNA, 46 bp, Artificial Sequence
  Synthesized adaptor oligonucleotide
  misc_feature (34)..(36): n is a, c, g, or t
tgcaggaccagagaattcgaatacagtgcgtgcnnnctagcgttac

SEQ ID NO: 6331 - DNA, 46 bp, Artificial Sequence
  Synthesized adaptor oligonucleotide
  misc_feature (34)..(36): n is a, c, g, or t
tgcaggaccagagaattcgaatacaatgtccgannnctagcgttac

SEQ ID NO: 6332 - DNA, 46 bp, Artificial Sequence
  Synthesized adaptor oligonucleotide
  misc_feature (34)..(36): n is a, c, g, or t
tgcaggaccagagaattcgaatacatgttatagnnnctagcgttac

SEQ ID NO: 6333 - DNA, 46 bp, Artificial Sequence
  Synthesized adaptor oligonucleotide
  misc_feature (34)..(36): n is a, c, g, or t
tgcaggaccagagaattcgaatacatgtcgtagnnnctagcgttac

SEQ ID NO: 6334 - DNA, 46 bp, Artificial Sequence
  Synthesized adaptor oligonucleotide
  misc_feature (34)..(36): n is a, c, g, or t
tgcaggaccagagaattcgaatacagacgcttannnctagcgttac

SEQ ID NO: 6335 - DNA, 46 bp, Artificial Sequence
  Synthesized adaptor oligonucleotide
  misc_feature (34)..(36): n is a, c, g, or t
tgcaggaccagagaattcgaatacagaattactnnnctagcgttac

SEQ ID NO: 6336 - DNA, 46 bp, Artificial Sequence
  Synthesized adaptor oligonucleotide
  misc_feature (34)..(36): n is a, c, g, or t
tgcaggaccagagaattcgaatacatcgaccccnnnctagcgttac

SEQ ID NO: 6337 - DNA, 46 bp, Artificial Sequence
  Synthesized adaptor oligonucleotide
  misc_feature (34)..(36): n is a, c, g, or t
tgcaggaccagagaattcgaatacagcctccacnnnctagcgttac

SEQ ID NO: 6338 - DNA, 46 bp, Artificial Sequence
  Synthesized adaptor oligonucleotide
  misc_feature (34)..(36): n is a, c, g, or t
tgcaggaccagagaattcgaatacactgtataannnctagcgttac

SEQ ID NO: 6339 - DNA, 46 bp, Artificial Sequence
  Synthesized adaptor oligonucleotide
  misc_feature (34)..(36): n is a, c, g, or t
tgcaggaccagagaattcgaatacattcgagtgnnnctagcgttac

SEQ ID NO: 6340 - DNA, 46 bp, Artificial Sequence
  Synthesized adaptor oligonucleotide
  misc_feature (34)..(36): n is a, c, g, or t
tgcaggaccagagaattcgaatacataagtgccnnnctagcgttac

SEQ ID NO: 6341 - DNA, 46 bp, Artificial Sequence
  Synthesized adaptor oligonucleotide
  misc_feature (34)..(36): n is a, c, g, or t
tgcaggaccagagaattcgaatacacagataaannnctagcgttac

SEQ ID NO: 6342 - DNA, 46 bp, Artificial Sequence
  Synthesized adaptor oligonucleotide
  misc_feature (34)..(36): n is a, c, g, or t
tgcaggaccagagaattcgaatacacgaatcacnnnctagcgttac

SEQ ID NO: 6343 - DNA, 46 bp, Artificial Sequence
  Synthesized adaptor oligonucleotide
  misc_feature (34)..(36): n is a, c, g, or t
tgcaggaccagagaattcgaatacagagcttacnnnctagcgttac

SEQ ID NO: 6344 - DNA, 46 bp, Artificial Sequence
  Synthesized adaptor oligonucleotide
  misc_feature (34)..(36): n is a, c, g, or t
tgcaggaccagagaattcgaatacatcatctgcnnnctagcgttac

SEQ ID NO: 6345 - DNA, 46 bp, Artificial Sequence
  Synthesized adaptor oligonucleotide
  misc_feature (34)..(36): n is a, c, g, or t
tgcaggaccagagaattcgaatacaccacgtggnnnctagcgttac

SEQ ID NO: 6346 - DNA, 46 bp, Artificial Sequence
  Synthesized adaptor oligonucleotide
  misc_feature (34)..(36): n is a, c, g, or t
tgcaggaccagagaattcgaatacacgtgtatgnnnctagcgttac

SEQ ID NO: 6347 - DNA, 46 bp, Artificial Sequence
  Synthesized adaptor oligonucleotide
  misc_feature (34)..(36): n is a, c, g, or t
tgcaggaccagagaattcgaatacactctccggnnnctagcgttac

SEQ ID NO: 6348 - DNA, 46 bp, Artificial Sequence
  Synthesized adaptor oligonucleotide
  misc_feature (34)..(36): n is a, c, g, or t
tgcaggaccagagaattcgaatacacaagagtgnnnctagcgttac

SEQ ID NO: 6349 - DNA, 46 bp, Artificial Sequence
  Synthesized adaptor oligonucleotide
  misc_feature (34)..(36): n is a, c, g, or t
tgcaggaccagagaattcgaatacatagctctcnnnctagcgttac

SEQ ID NO: 6350 - DNA, 46 bp, Artificial Sequence
  Synthesized adaptor oligonucleotide
  misc_feature (34)..(36): n is a, c, g, or t
tgcaggaccagagaattcgaatacagtggcaggnnnctagcgttac

SEQ ID NO: 6351 - DNA, 46 bp, Artificial Sequence
  Synthesized adaptor oligonucleotide
  misc_feature (34)..(36): n is a, c, g, or t
tgcaggaccagagaattcgaatacatgcatcgannnctagcgttac

SEQ ID NO: 6352 - DNA, 46 bp, Artificial Sequence
  Synthesized adaptor oligonucleotide
  misc_feature (34)..(36): n is a, c, g, or t
tgcaggaccagagaattcgaatacacggtccgannnctagcgttac

SEQ ID NO: 6353 - DNA, 46 bp, Artificial Sequence
  Synthesized adaptor oligonucleotide
  misc_feature (34)..(36): n is a, c, g, or t
tgcaggaccagagaattcgaatacaaagccactnnnctagcgttac

SEQ ID NO: 6354 - DNA, 46 bp, Artificial Sequence
  Synthesized adaptor oligonucleotide
  misc_feature (34)..(36): n is a, c, g, or t
tgcaggaccagagaattcgaatacagatcttttnnnctagcgttac

SEQ ID NO: 6355 - DNA, 46 bp, Artificial Sequence
  Synthesized adaptor oligonucleotide
  misc_feature (34)..(36): n is a, c, g, or t
tgcaggaccagagaattcgaatacaggctctaannnctagcgttac

SEQ ID NO: 6356 - DNA, 46 bp, Artificial Sequence
  Synthesized adaptor oligonucleotide
  misc_feature (34)..(36): n is a, c, g, or t
tgcaggaccagagaattcgaatacatctatgttnnnctagcgttac

SEQ ID NO: 6357 - DNA, 46 bp, Artificial Sequence
  Synthesized adaptor oligonucleotide
  misc_feature (34)..(36): n is a, c, g, or t
tgcaggaccagagaattcgaatacaaccgcgtgnnnctagcgttac

SEQ ID NO: 6358 - DNA, 46 bp, Artificial Sequence
  Synthesized adaptor oligonucleotide
  misc_feature (34)..(36): n is a, c, g, or t
tgcaggaccagagaattcgaatacagtactcctnnnctagcgttac

SEQ ID NO: 6359 - DNA, 46 bp, Artificial Sequence
  Synthesized adaptor oligonucleotide
  misc_feature (34)..(36): n is a, c, g, or t
tgcaggaccagagaattcgaatacaggagccctnnnctagcgttac

SEQ ID NO: 6360 - DNA, 46 bp, Artificial Sequence
  Synthesized adaptor oligonucleotide
  misc_feature (34)..(36): n is a, c, g, or t
tgcaggaccagagaattcgaatacatatcgagcnnnctagcgttac

SEQ ID NO: 6361 - DNA, 46 bp, Artificial Sequence
  Synthesized adaptor oligonucleotide
  misc_feature (34)..(36): n is a, c, g, or t
tgcaggaccagagaattcgaatacaccgttgaannnctagcgttac

SEQ ID NO: 6362 - DNA, 46 bp, Artificial Sequence
  Synthesized adaptor oligonucleotide
  misc_feature (34)..(36): n is a, c, g, or t
tgcaggaccagagaattcgaatacacgaagaacnnnctagcgttac

SEQ ID NO: 6363 - DNA, 46 bp, Artificial Sequence
  Synthesized adaptor oligonucleotide
  misc_feature (34)..(36): n is a, c, g, or t
tgcaggaccagagaattcgaatacaagtgatccnnnctagcgttac

SEQ ID NO: 6364 - DNA, 46 bp, Artificial Sequence
  Synthesized adaptor oligonucleotide
  misc_feature (34)..(36): n is a, c, g, or t
tgcaggaccagagaattcgaatacaggtcaactnnnctagcgttac

SEQ ID NO: 6365 - DNA, 46 bp, Artificial Sequence
  Synthesized adaptor oligonucleotide
  misc_feature (34)..(36): n is a, c, g, or t
tgcaggaccagagaattcgaatacatgacgtgtnnnctagcgttac

SEQ ID NO: 6366 - DNA, 46 bp, Artificial Sequence
  Synthesized adaptor oligonucleotide
  misc_feature (34)..(36): n is a, c, g, or t
tgcaggaccagagaattcgaatacattacaacannnctagcgttac

SEQ ID NO: 6367 - DNA, 46 bp, Artificial Sequence
  Synthesized adaptor oligonucleotide
  misc_feature (34)..(36): n is a, c, g, or t
tgcaggaccagagaattcgaatacaaaatgttcnnnctagcgttac

SEQ ID NO: 6368 - DNA, 46 bp, Artificial Sequence
  Synthesized adaptor oligonucleotide
  misc_feature (34)..(36): n is a, c, g, or t
tgcaggaccagagaattcgaatacattataacgnnnctagcgttac

SEQ ID NO: 6369 - DNA, 46 bp, Artificial Sequence
  Synthesized adaptor oligonucleotide
  misc_feature (34)..(36): n is a, c, g, or t
tgcaggaccagagaattcgaatacatccggatannngatcgacatg

SEQ ID NO: 6370 - DNA, 46 bp, Artificial Sequence
  Synthesized adaptor oligonucleotide
  misc_feature (34)..(36): n is a, c, g, or t
tgcaggaccagagaattcgaatacaagccctttnnngatcgacatg

SEQ ID NO: 6371 - DNA, 46 bp, Artificial Sequence
  Synthesized adaptor oligonucleotide
  misc_feature (34)..(36): n is a, c, g, or t
tgcaggaccagagaattcgaatacagtacactgnnngatcgacatg

SEQ ID NO: 6372 - DNA, 46 bp, Artificial Sequence
  Synthesized adaptor oligonucleotide
  misc_feature (34)..(36): n is a, c, g, or t
tgcaggaccagagaattcgaatacacgtgtagtnnngatcgacatg

SEQ ID NO: 6373 - DNA, 46 bp, Artificial Sequence
  Synthesized adaptor oligonucleotide
  misc_feature (34)..(36): n is a, c, g, or t
tgcaggaccagagaattcgaatacaggaaagtcnnngatcgacatg

SEQ ID NO: 6374 - DNA, 46 bp, Artificial Sequence
  Synthesized adaptor oligonucleotide
  misc_feature (34)..(36): n is a, c, g, or t
tgcaggaccagagaattcgaatacattctgcgtnnngatcgacatg

SEQ ID NO: 6375 - DNA, 46 bp, Artificial Sequence
  Synthesized adaptor oligonucleotide
  misc_feature (34)..(36): n is a, c, g, or t
tgcaggaccagagaattcgaatacatactcggannngatcgacatg

SEQ ID NO: 6376 - DNA, 46 bp, Artificial Sequence
  Synthesized adaptor oligonucleotide
  misc_feature (34)..(36): n is a, c, g, or t
tgcaggaccagagaattcgaatacacgtccaaannngatcgacatg

SEQ ID NO: 6377 - DNA, 46 bp, Artificial Sequence
  Synthesized adaptor oligonucleotide
  misc_feature (34)..(36): n is a, c, g, or t
tgcaggaccagagaattcgaatacattgaaccgnnngatcgacatg

SEQ ID NO: 6378 - DNA, 46 bp, Artificial Sequence
  Synthesized adaptor oligonucleotide
  misc_feature (34)..(36): n is a, c, g, or t
tgcaggaccagagaattcgaatacaggccgctannngatcgacatg

SEQ ID NO: 6379 - DNA, 46 bp, Artificial Sequence
  Synthesized adaptor oligonucleotide
  misc_feature (34)..(36): n is a, c, g, or t
tgcaggaccagagaattcgaatacagatacgtcnnngatcgacatg

SEQ ID NO: 6380 - DNA, 46 bp, Artificial Sequence
  Synthesized adaptor oligonucleotide
  misc_feature (34)..(36): n is a, c, g, or t
tgcaggaccagagaattcgaatacaattcaacannngatcgacatg

SEQ ID NO: 6381 - DNA, 46 bp, Artificial Sequence
  Synthesized adaptor oligonucleotide
  misc_feature (34)..(36): n is a, c, g, or t
tgcaggaccagagaattcgaatacagtgtgcatnnngatcgacatg

SEQ ID NO: 6382 - DNA, 46 bp, Artificial Sequence
  Synthesized adaptor oligonucleotide
  misc_feature (34)..(36): n is a, c, g, or t
tgcaggaccagagaattcgaatacagccatagtnnngatcgacatg

SEQ ID NO: 6383 - DNA, 46 bp, Artificial Sequence
  Synthesized adaptor oligonucleotide
  misc_feature (34)..(36): n is a, c, g, or t
tgcaggaccagagaattcgaatacactcatctgnnngatcgacatg

SEQ ID NO: 6384 - DNA, 46 bp, Artificial Sequence
  Synthesized adaptor oligonucleotide
  misc_feature (34)..(36): n is a, c, g, or t
tgcaggaccagagaattcgaatacaaaccgactnnngatcgacatg

SEQ ID NO: 6385 - DNA, 46 bp, Artificial Sequence
  Synthesized adaptor oligonucleotide
  misc_feature (34)..(36): n is a, c, g, or t
tgcaggaccagagaattcgaatacacatcgcccnnngatcgacatg

SEQ ID NO: 6386 - DNA, 46 bp, Artificial Sequence
  Synthesized adaptor oligonucleotide
  misc_feature (34)..(36): n is a, c, g, or t
tgcaggaccagagaattcgaatacataggatccnnngatcgacatg

SEQ ID NO: 6387 - DNA, 46 bp, Artificial Sequence
  Synthesized adaptor oligonucleotide
  misc_feature (34)..(36): n is a, c, g, or t
tgcaggaccagagaattcgaatacaatggcgttnnngatcgacatg

SEQ ID NO: 6388 - DNA, 46 bp, Artificial Sequence
  Synthesized adaptor oligonucleotide
  misc_feature (34)..(36): n is a, c, g, or t
tgcaggaccagagaattcgaatacactaaattgnnngatcgacatg

SEQ ID NO: 6389 - DNA, 46 bp, Artificial Sequence
  Synthesized adaptor oligonucleotide
  misc_feature (34)..(36): n is a, c, g, or t
tgcaggaccagagaattcgaatacaactacatannngatcgacatg

SEQ ID NO: 6390 - DNA, 46 bp, Artificial Sequence
  Synthesized adaptor oligonucleotide
  misc_feature (34)..(36): n is a, c, g, or t
tgcaggaccagagaattcgaatacacatcctcannngatcgacatg

SEQ ID NO: 6391 - DNA, 46 bp, Artificial Sequence
  Synthesized adaptor oligonucleotide
  misc_feature (34)..(36): n is a, c, g, or t
tgcaggaccagagaattcgaatacagatgtgagnnngatcgacatg

SEQ ID NO: 6392 - DNA, 46 bp, Artificial Sequence
  Synthesized adaptor oligonucleotide
  misc_feature (34)..(36): n is a, c, g, or t
tgcaggaccagagaattcgaatacaaggccaaannngatcgacatg

SEQ ID NO: 6393 - DNA, 46 bp, Artificial Sequence
  Synthesized adaptor oligonucleotide
  misc_feature (34)..(36): n is a, c, g, or t
tgcaggaccagagaattcgaatacaccaagctannngatcgacatg

SEQ ID NO: 6394 - DNA, 46 bp, Artificial Sequence
  Synthesized adaptor oligonucleotide
  misc_feature (34)..(36): n is a, c, g, or t
tgcaggaccagagaattcgaatacaaggagatcnnngatcgacatg

SEQ ID NO: 6395 - DNA, 46 bp, Artificial Sequence
  Synthesized adaptor oligonucleotide
  misc_feature (34)..(36): n is a, c, g, or t
tgcaggaccagagaattcgaatacacctccgacnnngatcgacatg

SEQ ID NO: 6396 - DNA, 46 bp, Artificial Sequence
  Synthesized adaptor oligonucleotide
  misc_feature (34)..(36): n is a, c, g, or t
tgcaggaccagagaattcgaatacacgctgtggnnngatcgacatg

SEQ ID NO: 6397 - DNA, 46 bp, Artificial Sequence
  Synthesized adaptor oligonucleotide
  misc_feature (34)..(36): n is a, c, g, or t
tgcaggaccagagaattcgaatacataccgcccnnngatcgacatg

SEQ ID NO: 6398 - DNA, 46 bp, Artificial Sequence
  Synthesized adaptor oligonucleotide
  misc_feature (34)..(36): n is a, c, g, or t
tgcaggaccagagaattcgaatacacgtcgcctnnngatcgacatg

SEQ ID NO: 6399 - DNA, 46 bp, Artificial Sequence
  Synthesized adaptor oligonucleotide
  misc_feature (34)..(36): n is a, c, g, or t
tgcaggaccagagaattcgaatacacctcaccgnnngatcgacatg

SEQ ID NO: 6400 - DNA, 46 bp, Artificial Sequence
  Synthesized adaptor oligonucleotide
  misc_feature (34)..(36): n is a, c, g, or t
tgcaggaccagagaattcgaatacagcctggacnnngatcgacatg

SEQ ID NO: 6401 - DNA, 46 bp, Artificial Sequence
  Synthesized adaptor oligonucleotide
  misc_feature (34)..(36): n is a, c, g, or t
tgcaggaccagagaattcgaatacaacttggacnnngatcgacatg

SEQ ID NO: 6402 - DNA, 46 bp, Artificial Sequence
  Synthesized adaptor oligonucleotide
  misc_feature (34)..(36): n is a, c, g, or t
tgcaggaccagagaattcgaatacatgttgcctnnngatcgacatg

SEQ ID NO: 6403 - DNA, 46 bp, Artificial Sequence
  Synthesized adaptor oligonucleotide
  misc_feature (34)..(36): n is a, c, g, or t
tgcaggaccagagaattcgaatacacggcacgtnnngatcgacatg

SEQ ID NO: 6404 - DNA, 46 bp, Artificial Sequence
  Synthesized adaptor oligonucleotide
  misc_feature (34)..(36): n is a, c, g, or t
tgcaggaccagagaattcgaatacaaggtgtgannngatcgacatg

SEQ ID NO: 6405 - DNA, 46 bp, Artificial Sequence
  Synthesized adaptor oligonucleotide
  misc_feature (34)..(36): n is a, c, g, or t
tgcaggaccagagaattcgaatacaaacgacgannngatcgacatg

SEQ ID NO: 6406 - DNA, 46 bp, Artificial Sequence
  Synthesized adaptor oligonucleotide
  misc_feature (34)..(36): n is a, c, g, or t
tgcaggaccagagaattcgaatacacatcactcnnngatcgacatg

SEQ ID NO: 6407 - DNA, 46 bp, Artificial Sequence
  Synthesized adaptor oligonucleotide
  misc_feature (34)..(36): n is a, c, g, or t
tgcaggaccagagaattcgaatacataatgctannngatcgacatg

SEQ ID NO: 6408 - DNA, 46 bp, Artificial Sequence
  Synthesized adaptor oligonucleotide
  misc_feature (34)..(36): n is a, c, g, or t
tgcaggaccagagaattcgaatacacgccttgcnnngatcgacatg

SEQ ID NO: 6409 - DNA, 46 bp, Artificial Sequence
  Synthesized adaptor oligonucleotide
  misc_feature (34)..(36): n is a, c, g, or t
tgcaggaccagagaattcgaatacatgatcagcnnngatcgacatg

SEQ ID NO: 6410 - DNA, 46 bp, Artificial Sequence
  Synthesized adaptor oligonucleotide
  misc_feature (34)..(36): n is a, c, g, or t
tgcaggaccagagaattcgaatacacttcggaannngatcgacatg

SEQ ID NO: 6411 - DNA, 46 bp, Artificial Sequence
  Synthesized adaptor oligonucleotide
  misc_feature (34)..(36): n is a, c, g, or t
tgcaggaccagagaattcgaatacacgcaaatcnnngatcgacatg

SEQ ID NO: 6412 - DNA, 46 bp, Artificial Sequence
  Synthesized adaptor oligonucleotide
  misc_feature (34)..(36): n is a, c, g, or t
tgcaggaccagagaattcgaatacaagagaaccnnngatcgacatg

SEQ ID NO: 6413 - DNA, 46 bp, Artificial Sequence
  Synthesized adaptor oligonucleotide
  misc_feature (34)..(36): n is a, c, g, or t
tgcaggaccagagaattcgaatacatcgacgatnnngatcgacatg

SEQ ID NO: 6414 - DNA, 46 bp, Artificial Sequence
  Synthesized adaptor oligonucleotide
  misc_feature (34)..(36): n is a, c, g, or t
tgcaggaccagagaattcgaatacacagcaagannngatcgacatg

SEQ ID NO: 6415 - DNA, 46 bp, Artificial Sequence
  Synthesized adaptor oligonucleotide
  misc_feature (34)..(36): n is a, c, g, or t
tgcaggaccagagaattcgaatacacaaagtaannngatcgacatg

SEQ ID NO: 6416 - DNA, 46 bp, Artificial Sequence
  Synthesized adaptor oligonucleotide
  misc_feature (34)..(36): n is a, c, g, or t
tgcaggaccagagaattcgaatacagaaatcaannngatcgacatg

SEQ ID NO: 6417 - DNA, 46 bp, Artificial Sequence
  Synthesized adaptor oligonucleotide
  misc_feature (34)..(36): n is a, c, g, or t
tgcaggaccagagaattcgaatacactcctgatnnngatcgacatg

SEQ ID NO: 6418 - DNA, 46 bp, Artificial Sequence
  Synthesized adaptor oligonucleotide
  misc_feature (34)..(36): n is a, c, g, or t
tgcaggaccagagaattcgaatacaactatagtnnngatcgacatg

SEQ ID NO: 6419 - DNA, 46 bp, Artificial Sequence
  Synthesized adaptor oligonucleotide
  misc_feature (34)..(36): n is a, c, g, or t
tgcaggaccagagaattcgaatacaggtagttcnnngatcgacatg

SEQ ID NO: 6420 - DNA, 46 bp, Artificial Sequence
  Synthesized adaptor oligonucleotide
  misc_feature (34)..(36): n is a, c, g, or t
tgcaggaccagagaattcgaatacacggaacttnnngatcgacatg

SEQ ID NO: 6421 - DNA, 46 bp, Artificial Sequence
  Synthesized adaptor oligonucleotide
  misc_feature (34)..(36): n is a, c, g, or t
tgcaggaccagagaattcgaatacaggatctgtnnngatcgacatg

SEQ ID NO: 6422 - DNA, 46 bp, Artificial Sequence
  Synthesized adaptor oligonucleotide
  misc_feature (34)..(36): n is a, c, g, or t
tgcaggaccagagaattcgaatacaattccgctnnngatcgacatg

SEQ ID NO: 6423 - DNA, 46 bp, Artificial Sequence
  Synthesized adaptor oligonucleotide
  misc_feature (34)..(36): n is a, c, g, or t
tgcaggaccagagaattcgaatacatttctacannngatcgacatg

SEQ ID NO: 6424 - DNA, 46 bp, Artificial Sequence
  Synthesized adaptor oligonucleotide
  misc_feature (34)..(36): n is a, c, g, or t
tgcaggaccagagaattcgaatacatcccagccnnngatcgacatg

SEQ ID NO: 6425 - DNA, 46 bp, Artificial Sequence
  Synthesized adaptor oligonucleotide
  misc_feature (34)..(36): n is a, c, g, or t
tgcaggaccagagaattcgaatacacttaccacnnngatcgacatg

SEQ ID NO: 6426 - DNA, 46 bp, Artificial Sequence
  Synthesized adaptor oligonucleotide
  misc_feature (34)..(36): n is a, c, g, or t
tgcaggaccagagaattcgaatacaaccttctgnnngatcgacatg

SEQ ID NO: 6427 - DNA, 46 bp, Artificial Sequence
  Synthesized adaptor oligonucleotide
  misc_feature (34)..(36): n is a, c, g, or t
tgcaggaccagagaattcgaatacacgtggtcgnnngatcgacatg

SEQ ID NO: 6428 - DNA, 46 bp, Artificial Sequence
  Synthesized adaptor oligonucleotide
  misc_feature (34)..(36): n is a, c, g, or t
tgcaggaccagagaattcgaatacaccaaactgnnngatcgacatg

SEQ ID NO: 6429 - DNA, 46 bp, Artificial Sequence
  Synthesized adaptor oligonucleotide
  misc_feature (34)..(36): n is a, c, g, or t
tgcaggaccagagaattcgaatacactcacgccnnntgcatcaggt

SEQ ID NO: 6430 - DNA, 46 bp, Artificial Sequence
  Synthesized adaptor oligonucleotide
  misc_feature (34)..(36): n is a, c, g, or t
tgcaggaccagagaattcgaatacagacgagcgnnntgcatcaggt

SEQ ID NO: 6431 - DNA, 46 bp, Artificial Sequence
  Synthesized adaptor oligonucleotide
  misc_feature (34)..(36): n is a, c, g, or t
tgcaggaccagagaattcgaatacaagaatggcnnntgcatcaggt

SEQ ID NO: 6432 - DNA, 46 bp, Artificial Sequence
  Synthesized adaptor oligonucleotide
  misc_feature (34)..(36): n is a, c, g, or t
tgcaggaccagagaattcgaatacaccagtcccnnntgcatcaggt

SEQ ID NO: 6433 - DNA, 46 bp, Artificial Sequence
  Synthesized adaptor oligonucleotide
  misc_feature (34)..(36): n is a, c, g, or t
tgcaggaccagagaattcgaatacaaaagtatgnnntgcatcaggt

SEQ ID NO: 6434 - DNA, 46 bp, Artificial Sequence
  Synthesized adaptor oligonucleotide
  misc_feature (34)..(36): n is a, c, g, or t
tgcaggaccagagaattcgaatacacgtacgtannntgcatcaggt

SEQ ID NO: 6435 - DNA, 46 bp, Artificial Sequence
  Synthesized adaptor oligonucleotide
  misc_feature (34)..(36): n is a, c, g, or t
tgcaggaccagagaattcgaatacacagcgccannntgcatcaggt

SEQ ID NO: 6436 - DNA, 46 bp, Artificial Sequence
  Synthesized adaptor oligonucleotide
  misc_feature (34)..(36): n is a, c, g, or t
tgcaggaccagagaattcgaatacagctctccgnnntgcatcaggt

SEQ ID NO: 6437 - DNA, 46 bp, Artificial Sequence
  Synthesized adaptor oligonucleotide
  misc_feature (34)..(36): n is a, c, g, or t
tgcaggaccagagaattcgaatacaggccgtacnnntgcatcaggt

SEQ ID NO: 6438 - DNA, 46 bp, Artificial Sequence
  Synthesized adaptor oligonucleotide
  misc_feature (34)..(36): n is a, c, g, or t
tgcaggaccagagaattcgaatacagagagtgtnnntgcatcaggt

SEQ ID NO: 6439 - DNA, 46 bp, Artificial Sequence
  Synthesized adaptor oligonucleotide
  misc_feature (34)..(36): n is a, c, g, or t
tgcaggaccagagaattcgaatacaatggagtgnnntgcatcaggt

SEQ ID NO: 6440 - DNA, 46 bp, Artificial Sequence
  Synthesized adaptor oligonucleotide
  misc_feature (34)..(36): n is a, c, g, or t
tgcaggaccagagaattcgaatacatcggccgannntgcatcaggt

SEQ ID NO: 6441 - DNA, 46 bp, Artificial Sequence
  Synthesized adaptor oligonucleotide
  misc_feature (34)..(36): n is a, c, g, or t
tgcaggaccagagaattcgaatacaatcgattannntgcatcaggt

SEQ ID NO: 6442 - DNA, 46 bp, Artificial Sequence
  Synthesized adaptor oligonucleotide
  misc_feature (34)..(36): n is a, c, g, or t
tgcaggaccagagaattcgaatacacccaacaannntgcatcaggt

SEQ ID NO: 6443 - DNA, 46 bp, Artificial Sequence
  Synthesized adaptor oligonucleotide
  misc_feature (34)..(36): n is a, c, g, or t
tgcaggaccagagaattcgaatacatgtagattnnntgcatcaggt

SEQ ID NO: 6444 - DNA, 46 bp, Artificial Sequence
  Synthesized adaptor oligonucleotide
  misc_feature (34)..(36): n is a, c, g, or t
tgcaggaccagagaattcgaatacaaccggaggnnntgcatcaggt

SEQ ID NO: 6445 - DNA, 46 bp, Artificial Sequence
  Synthesized adaptor oligonucleotide
  misc_feature (34)..(36): n is a, c, g, or t
tgcaggaccagagaattcgaatacacacctgaannntgcatcaggt

SEQ ID NO: 6446 - DNA, 46 bp, Artificial Sequence
  Synthesized adaptor oligonucleotide
  misc_feature (34)..(36): n is a, c, g, or t
tgcaggaccagagaattcgaatacaacatgtgcnnntgcatcaggt

SEQ ID NO: 6447 - DNA, 46 bp, Artificial Sequence
  Synthesized adaptor oligonucleotide
  misc_feature (34)..(36): n is a, c, g, or t
tgcaggaccagagaattcgaatacacaggatctnnntgcatcaggt

SEQ ID NO: 6448 - DNA, 46 bp, Artificial Sequence
  Synthesized adaptor oligonucleotide
  misc_feature (34)..(36): n is a, c, g, or t
tgcaggaccagagaattcgaatacacgtttgtcnnntgcatcaggt

SEQ ID NO: 6449 - DNA, 46 bp, Artificial Sequence
  Synthesized adaptor oligonucleotide
  misc_feature (34)..(36): n is a, c, g, or t
tgcaggaccagagaattcgaatacaaaatcaagnnntgcatcaggt

SEQ ID NO: 6450 - DNA, 46 bp, Artificial Sequence
  Synthesized adaptor oligonucleotide
  misc_feature (34)..(36): n is a, c, g, or t
tgcaggaccagagaattcgaatacatcaacatannntgcatcaggt

SEQ ID NO: 6451 - DNA, 46 bp, Artificial Sequence
  Synthesized adaptor oligonucleotide
  misc_feature (34)..(36): n is a, c, g, or t
tgcaggaccagagaattcgaatacaatgaaggcnnntgcatcaggt

SEQ ID NO: 6452 - DNA, 46 bp, Artificial Sequence
  Synthesized adaptor oligonucleotide
  misc_feature (34)..(36): n is a, c, g, or t
tgcaggaccagagaattcgaatacacaagtggannntgcatcaggt

SEQ ID NO: 6453 - DNA, 46 bp, Artificial Sequence
  Synthesized adaptor oligonucleotide
  misc_feature (34)..(36): n is a, c, g, or t
tgcaggaccagagaattcgaatacaagcaaaatnnntgcatcaggt

SEQ ID NO: 6454 - DNA, 46 bp, Artificial Sequence
  Synthesized adaptor oligonucleotide
  misc_feature (34)..(36): n is a, c, g, or t
tgcaggaccagagaattcgaatacaacagatccnnntgcatcaggt

SEQ ID NO: 6455 - DNA, 46 bp, Artificial Sequence
  Synthesized adaptor oligonucleotide
  misc_feature (34)..(36): n is a, c, g, or t
tgcaggaccagagaattcgaatacatacgccttnnntgcatcaggt

SEQ ID NO: 6456 - DNA, 46 bp, Artificial Sequence
  Synthesized adaptor oligonucleotide
  misc_feature (34)..(36): n is a, c, g, or t
tgcaggaccagagaattcgaatacaagcgctatnnntgcatcaggt

SEQ ID NO: 6457 - DNA, 46 bp, Artificial Sequence
  Synthesized adaptor oligonucleotide
  misc_feature (34)..(36): n is a, c, g, or t
tgcaggaccagagaattcgaatacaagtgatggnnntgcatcaggt

SEQ ID NO: 6458 - DNA, 46 bp, Artificial Sequence
  Synthesized adaptor oligonucleotide
  misc_feature (34)..(36): n is a, c, g, or t
tgcaggaccagagaattcgaatacacggatgaannntgcatcaggt

SEQ ID NO: 6459 - DNA, 46 bp, Artificial Sequence
  Synthesized adaptor oligonucleotide
  misc_feature (34)..(36): n is a, c, g, or t
tgcaggaccagagaattcgaatacagacataggnnntgcatcaggt

SEQ ID NO: 6460 - DNA, 46 bp, Artificial Sequence
  Synthesized adaptor oligonucleotide
  misc_feature (34)..(36): n is a, c, g, or t
tgcaggaccagagaattcgaatacaattgcgtgnnntgcatcaggt

SEQ ID NO: 6461 - DNA, 46 bp, Artificial Sequence
  Synthesized adaptor oligonucleotide
  misc_feature (34)..(36): n is a, c, g, or t
tgcaggaccagagaattcgaatacactacagtgnnntgcatcaggt

SEQ ID NO: 6462 - DNA, 46 bp, Artificial Sequence
  Synthesized adaptor oligonucleotide
  misc_feature (34)..(36): n is a, c, g, or t
tgcaggaccagagaattcgaatacaccgtccacnnntgcatcaggt

SEQ ID NO: 6463 - DNA, 46 bp, Artificial Sequence
  Synthesized adaptor oligonucleotide
  misc_feature (34)..(36): n is a, c, g, or t
tgcaggaccagagaattcgaatacaaagcccatnnntgcatcaggt

SEQ ID NO: 6464 - DNA, 46 bp, Artificial Sequence
  Synthesized adaptor oligonucleotide
  misc_feature (34)..(36): n is a, c, g, or t
tgcaggaccagagaattcgaatacacgaggcctnnntgcatcaggt

SEQ ID NO: 6465 - DNA, 46 bp, Artificial Sequence
  Synthesized adaptor oligonucleotide
  misc_feature (34)..(36): n is a, c, g, or t
tgcaggaccagagaattcgaatacaacctatccnnntgcatcaggt

SEQ ID NO: 6466 - DNA, 46 bp, Artificial Sequence
  Synthesized adaptor oligonucleotide
  misc_feature (34)..(36): n is a, c, g, or t
tgcaggaccagagaattcgaatacaaggcgagcnnntgcatcaggt

SEQ ID NO: 6467 - DNA, 46 bp, Artificial Sequence
  Synthesized adaptor oligonucleotide
  misc_feature (34)..(36): n is a, c, g, or t
tgcaggaccagagaattcgaatacagagaactgnnntgcatcaggt

SEQ ID NO: 6468 - DNA, 46 bp, Artificial Sequence
  Synthesized adaptor oligonucleotide
  misc_feature (34)..(36): n is a, c, g, or t
tgcaggaccagagaattcgaatacatggtgttgnnntgcatcaggt

SEQ ID NO: 6469 - DNA, 46 bp, Artificial Sequence
  Synthesized adaptor oligonucleotide
  misc_feature (34)..(36): n is a, c, g, or t
tgcaggaccagagaattcgaatacactaaatcannntgcatcaggt

SEQ ID NO: 6470 - DNA, 46 bp, Artificial Sequence
  Synthesized adaptor oligonucleotide
  misc_feature (34)..(36): n is a, c, g, or t
tgcaggaccagagaattcgaatacaatttccgcnnntgcatcaggt

SEQ ID NO: 6471 - DNA, 46 bp, Artificial Sequence
  Synthesized adaptor oligonucleotide
  misc_feature (34)..(36): n is a, c, g, or t
tgcaggaccagagaattcgaatacacctccatannntgcatcaggt

SEQ ID NO: 6472 - DNA, 46 bp, Artificial Sequence
  Synthesized adaptor oligonucleotide
  misc_feature (34)..(36): n is a, c, g, or t
tgcaggaccagagaattcgaatacattactactnnntgcatcaggt

SEQ ID NO: 6473 - DNA, 46 bp, Artificial Sequence
  Synthesized adaptor oligonucleotide
  misc_feature (34)..(36): n is a, c, g, or t
tgcaggaccagagaattcgaatacatcgtttatnnntgcatcaggt

SEQ ID NO: 6474 - DNA, 46 bp, Artificial Sequence
  Synthesized adaptor oligonucleotide
  misc_feature (34)..(36): n is a, c, g, or t
tgcaggaccagagaattcgaatacaattcaatgnnntgcatcaggt

SEQ ID NO: 6475 - DNA, 46 bp, Artificial Sequence
  Synthesized adaptor oligonucleotide
  misc_feature (34)..(36): n is a, c, g, or t
tgcaggaccagagaattcgaatacaaaccacacnnntgcatcaggt

SEQ ID NO: 6476 - DNA, 46 bp, Artificial Sequence
  Synthesized adaptor oligonucleotide
  misc_feature (34)..(36): n is a, c, g, or t
tgcaggaccagagaattcgaatacatacccgccnnntgcatcaggt

SEQ ID NO: 6477 - DNA, 46 bp, Artificial Sequence
  Synthesized adaptor oligonucleotide
  misc_feature (34)..(36): n is a, c, g, or t
tgcaggaccagagaattcgaatacaccatggcgnnntgcatcaggt

SEQ ID NO: 6478 - DNA, 46 bp, Artificial Sequence
  Synthesized adaptor oligonucleotide
  misc_feature (34)..(36): n is a, c, g, or t
tgcaggaccagagaattcgaatacacctgagtannntgcatcaggt

SEQ ID NO: 6479 - DNA, 46 bp, Artificial Sequence
  Synthesized adaptor oligonucleotide
  misc_feature (34)..(36): n is a, c, g, or t
tgcaggaccagagaattcgaatacaggatgtctnnntgcatcaggt

SEQ ID NO: 6480 - DNA, 46 bp, Artificial Sequence
  Synthesized adaptor oligonucleotide
  misc_feature (34)..(36): n is a, c, g, or t
tgcaggaccagagaattcgaatacaaagaccctnnntgcatcaggt

SEQ ID NO: 6481 - DNA, 46 bp, Artificial Sequence
  Synthesized adaptor oligonucleotide
  misc_feature (34)..(36): n is a, c, g, or t
tgcaggaccagagaattcgaatacagtacttggnnntgcatcaggt

SEQ ID NO: 6482 - DNA, 46 bp, Artificial Sequence
  Synthesized adaptor oligonucleotide
  misc_feature (34)..(36): n is a, c, g, or t
tgcaggaccagagaattcgaatacatccctcttnnntgcatcaggt

SEQ ID NO: 6483 - DNA, 46 bp, Artificial Sequence
  Synthesized adaptor oligonucleotide
  misc_feature (34)..(36): n is a, c, g, or t
tgcaggaccagagaattcgaatacatacttactnnntgcatcaggt

SEQ ID NO: 6484 - DNA, 46 bp, Artificial Sequence
  Synthesized adaptor oligonucleotide
  misc_feature (34)..(36): n is a, c, g, or t
tgcaggaccagagaattcgaatacaggttttccnnntgcatcaggt

SEQ ID NO: 6485 - DNA, 46 bp, Artificial Sequence
  Synthesized adaptor oligonucleotide
  misc_feature (34)..(36): n is a, c, g, or t
tgcaggaccagagaattcgaatacaggatcactnnntgcatcaggt

SEQ ID NO: 6486 - DNA, 46 bp, Artificial Sequence
  Synthesized adaptor oligonucleotide
  misc_feature (34)..(36): n is a, c, g, or t
tgcaggaccagagaattcgaatacattgatggcnnntgcatcaggt

SEQ ID NO: 6487 - DNA, 46 bp, Artificial Sequence
  Synthesized adaptor oligonucleotide
  misc_feature (34)..(36): n is a, c, g, or t
tgcaggaccagagaattcgaatacaccacattcnnntgcatcaggt

SEQ ID NO: 6488 - DNA, 46 bp, Artificial Sequence
  Synthesized adaptor oligonucleotide
  misc_feature (34)..(36): n is a, c, g, or t
tgcaggaccagagaattcgaatacacaaaaagtnnntgcatcaggt

SEQ ID NO: 6489 - DNA, 46 bp, Artificial Sequence
  Synthesized adaptor oligonucleotide
  misc_feature (34)..(36): n is a, c, g, or t
tgcaggaccagagaattcgaatacacagtattannnacgtatgcca

SEQ ID NO: 6490 - DNA, 46 bp, Artificial Sequence
  Synthesized adaptor oligonucleotide
  misc_feature (34)..(36): n is a, c, g, or t
tgcaggaccagagaattcgaatacagtactaatnnnacgtatgcca

SEQ ID NO: 6491 - DNA, 46 bp, Artificial Sequence
  Synthesized adaptor oligonucleotide
  misc_feature (34)..(36): n is a, c, g, or t
tgcaggaccagagaattcgaatacatttatgctnnnacgtatgcca

SEQ ID NO: 6492 - DNA, 46 bp, Artificial Sequence
  Synthesized adaptor oligonucleotide
  misc_feature (34)..(36): n is a, c, g, or t
tgcaggaccagagaattcgaatacagtcatcctnnnacgtatgcca

SEQ ID NO: 6493 - DNA, 46 bp, Artificial Sequence
  Synthesized adaptor oligonucleotide
  misc_feature (34)..(36): n is a, c, g, or t
tgcaggaccagagaattcgaatacacgaataaannnacgtatgcca

SEQ ID NO: 6494 - DNA, 46 bp, Artificial Sequence
  Synthesized adaptor oligonucleotide
  misc_feature (34)..(36): n is a, c, g, or t
tgcaggaccagagaattcgaatacagacgtatcnnnacgtatgcca

SEQ ID NO: 6495 - DNA, 46 bp, Artificial Sequence
  Synthesized adaptor oligonucleotide
  misc_feature (34)..(36): n is a, c, g, or t
tgcaggaccagagaattcgaatacaaattcacannnacgtatgcca

SEQ ID NO: 6496 - DNA, 46 bp, Artificial Sequence
  Synthesized adaptor oligonucleotide
  misc_feature (34)..(36): n is a, c, g, or t
tgcaggaccagagaattcgaatacaaatccgcannnacgtatgcca

SEQ ID NO: 6497 - DNA, 46 bp, Artificial Sequence
  Synthesized adaptor oligonucleotide
  misc_feature (34)..(36): n is a, c, g, or t
tgcaggaccagagaattcgaatacaacctatttnnnacgtatgcca

SEQ ID NO: 6498 - DNA, 46 bp, Artificial Sequence
  Synthesized adaptor oligonucleotide
  misc_feature (34)..(36): n is a, c, g, or t
tgcaggaccagagaattcgaatacagcttactcnnnacgtatgcca

SEQ ID NO: 6499 - DNA, 46 bp, Artificial Sequence
  Synthesized adaptor oligonucleotide
  misc_feature (34)..(36): n is a, c, g, or t
tgcaggaccagagaattcgaatacattggatgcnnnacgtatgcca

SEQ ID NO: 6500 - DNA, 46 bp, Artificial Sequence
  Synthesized adaptor oligonucleotide
  misc_feature (34)..(36): n is a, c, g, or t
tgcaggaccagagaattcgaatacagcggacgannnacgtatgcca

SEQ ID NO: 6501 - DNA, 46 bp, Artificial Sequence
  Synthesized adaptor oligonucleotide
  misc_feature (34)..(36): n is a, c, g, or t
tgcaggaccagagaattcgaatacaacaagtttnnnacgtatgcca

SEQ ID NO: 6502 - DNA, 46 bp, Artificial Sequence
  Synthesized adaptor oligonucleotide
  misc_feature (34)..(36): n is a, c, g, or t
tgcaggaccagagaattcgaatacatatctcatnnnacgtatgcca

SEQ ID NO: 6503 - DNA, 46 bp, Artificial Sequence
  Synthesized adaptor oligonucleotide
  misc_feature (34)..(36): n is a, c, g, or t
tgcaggaccagagaattcgaatacaggtttggtnnnacgtatgcca

SEQ ID NO: 6504 - DNA, 46 bp, Artificial Sequence
  Synthesized adaptor oligonucleotide
  misc_feature (34)..(36): n is a, c, g, or t
tgcaggaccagagaattcgaatacataattcctnnnacgtatgcca

SEQ ID NO: 6505 - DNA, 46 bp, Artificial Sequence
  Synthesized adaptor oligonucleotide
  misc_feature (34)..(36): n is a, c, g, or t
tgcaggaccagagaattcgaatacaacgtcgtannnacgtatgcca

SEQ ID NO: 6506 - DNA, 46 bp, Artificial Sequence
  Synthesized adaptor oligonucleotide
  misc_feature (34)..(36): n is a, c, g, or t
tgcaggaccagagaattcgaatacagaagctagnnnacgtatgcca

SEQ ID NO: 6507 - DNA, 46 bp, Artificial Sequence
  Synthesized adaptor oligonucleotide
  misc_feature (34)..(36): n is a, c, g, or t
tgcaggaccagagaattcgaatacaacgaatccnnnacgtatgcca

SEQ ID NO: 6508 - DNA, 46 bp, Artificial Sequence
  Synthesized adaptor oligonucleotide
  misc_feature (34)..(36): n is a, c, g, or t
tgcaggaccagagaattcgaatacatcttaatcnnnacgtatgcca

SEQ ID NO: 6509 - DNA, 46 bp, Artificial Sequence
  Synthesized adaptor oligonucleotide
  misc_feature (34)..(36): n is a, c, g, or t
tgcaggaccagagaattcgaatacagcttttcgnnnacgtatgcca

SEQ ID NO: 6510 - DNA, 46 bp, Artificial Sequence
  Synthesized adaptor oligonucleotide
  misc_feature (34)..(36): n is a, c, g, or t
tgcaggaccagagaattcgaatacatgctgagtnnnacgtatgcca

SEQ ID NO: 6511 - DNA, 46 bp, Artificial Sequence
  Synthesized adaptor oligonucleotide
  misc_feature (34)..(36): n is a, c, g, or t
tgcaggaccagagaattcgaatacacgttgcaannnacgtatgcca

SEQ ID NO: 6512 - DNA, 46 bp, Artificial Sequence
  Synthesized adaptor oligonucleotide
  misc_feature (34)..(36): n is a, c, g, or t
tgcaggaccagagaattcgaatacacagtacgtnnnacgtatgcca

SEQ ID NO: 6513 - DNA, 46 bp, Artificial Sequence
  Synthesized adaptor oligonucleotide
  misc_feature (34)..(36): n is a, c, g, or t
tgcaggaccagagaattcgaatacatggatttannnacgtatgcca

SEQ ID NO: 6514 - DNA, 46 bp, Artificial Sequence
  Synthesized adaptor oligonucleotide
  misc_feature (34)..(36): n is a, c, g, or t
tgcaggaccagagaattcgaatacagtgtagagnnnacgtatgcca

SEQ ID NO: 6515 - DNA, 46 bp, Artificial Sequence
  Synthesized adaptor oligonucleotide
  misc_feature (34)..(36): n is a, c, g, or t
tgcaggaccagagaattcgaatacactttagaannnacgtatgcca

SEQ ID NO: 6516 - DNA, 46 bp, Artificial Sequence
  Synthesized adaptor oligonucleotide
  misc_feature (34)..(36): n is a, c, g, or t
tgcaggaccagagaattcgaatacaatatagtcnnnacgtatgcca

SEQ ID NO: 6517 - DNA, 46 bp, Artificial Sequence
  Synthesized adaptor oligonucleotide
  misc_feature (34)..(36): n is a, c, g, or t
tgcaggaccagagaattcgaatacagtagagcannnacgtatgcca

SEQ ID NO: 6518 - DNA, 46 bp, Artificial Sequence
  Synthesized adaptor oligonucleotide
  misc_feature (34)..(36): n is a, c, g, or t
tgcaggaccagagaattcgaatacataaataccnnnacgtatgcca

SEQ ID NO: 6519 - DNA, 46 bp, Artificial Sequence
  Synthesized adaptor oligonucleotide
  misc_feature (34)..(36): n is a, c, g, or t
tgcaggaccagagaattcgaatacacaggacaannnacgtatgcca

SEQ ID NO: 6520 - DNA, 46 bp, Artificial Sequence
  Synthesized adaptor oligonucleotide
  misc_feature (34)..(36): n is a, c, g, or t
tgcaggaccagagaattcgaatacaatatcacannnacgtatgcca

SEQ ID NO: 6521 - DNA, 46 bp, Artificial Sequence
  Synthesized adaptor oligonucleotide
  misc_feature (34)..(36): n is a, c, g, or t
tgcaggaccagagaattcgaatacatgaatcatnnnacgtatgcca

SEQ ID NO: 6522 - DNA, 46 bp, Artificial Sequence
  Synthesized adaptor oligonucleotide
  misc_feature (34)..(36): n is a, c, g, or t
tgcaggaccagagaattcgaatacactacgtagnnnacgtatgcca

SEQ ID NO: 6523 - DNA, 46 bp, Artificial Sequence
  Synthesized adaptor oligonucleotide
  misc_feature (34)..(36): n is a, c, g, or t
tgcaggaccagagaattcgaatacagtacatcgnnnacgtatgcca

SEQ ID NO: 6524 - DNA, 46 bp, Artificial Sequence
  Synthesized adaptor oligonucleotide
  misc_feature (34)..(36): n is a, c, g, or t
tgcaggaccagagaattcgaatacacgcagtgcnnnacgtatgcca

SEQ ID NO: 6525 - DNA, 46 bp, Artificial Sequence
  Synthesized adaptor oligonucleotide
  misc_feature (34)..(36): n is a, c, g, or t
tgcaggaccagagaattcgaatacaaacaaagtnnnacgtatgcca

SEQ ID NO: 6526 - DNA, 46 bp, Artificial Sequence
  Synthesized adaptor oligonucleotide
  misc_feature (34)..(36): n is a, c, g, or t
tgcaggaccagagaattcgaatacaaaacttcannnacgtatgcca

SEQ ID NO: 6527 - DNA, 46 bp, Artificial Sequence
  Synthesized adaptor oligonucleotide
  misc_feature (34)..(36): n is a, c, g, or t
tgcaggaccagagaattcgaatacaaggagccgnnnacgtatgcca

SEQ ID NO: 6528 - DNA, 46 bp, Artificial Sequence
  Synthesized adaptor oligonucleotide
  misc_feature (34)..(36): n is a, c, g, or t
tgcaggaccagagaattcgaatacacgtgacatnnnacgtatgcca

SEQ ID NO: 6529 - DNA, 46 bp, Artificial Sequence
  Synthesized adaptor oligonucleotide
  misc_feature (34)..(36): n is a, c, g, or t
tgcaggaccagagaattcgaatacaatacatcannnacgtatgcca

SEQ ID NO: 6530 - DNA, 46 bp, Artificial Sequence
  Synthesized adaptor oligonucleotide
  misc_feature (34)..(36): n is a, c, g, or t
tgcaggaccagagaattcgaatacaaataacctnnnacgtatgcca

SEQ ID NO: 6531 - DNA, 46 bp, Artificial Sequence
  Synthesized adaptor oligonucleotide
  misc_feature (34)..(36): n is a, c, g, or t
tgcaggaccagagaattcgaatacaccagctttnnnacgtatgcca

SEQ ID NO: 6532 - DNA, 46 bp, Artificial Sequence
  Synthesized adaptor oligonucleotide
  misc_feature (34)..(36): n is a, c, g, or t
tgcaggaccagagaattcgaatacatccgtttgnnnacgtatgcca

SEQ ID NO: 6533 - DNA, 46 bp, Artificial Sequence
  Synthesized adaptor oligonucleotide
  misc_feature (34)..(36): n is a, c, g, or t
tgcaggaccagagaattcgaatacacagtcggcnnnacgtatgcca

SEQ ID NO: 6534 - DNA, 46 bp, Artificial Sequence
  Synthesized adaptor oligonucleotide
  misc_feature (34)..(36): n is a, c, g, or t
tgcaggaccagagaattcgaatacatgatcggtnnnacgtatgcca

SEQ ID NO: 6535 - DNA, 46 bp, Artificial Sequence
  Synthesized adaptor oligonucleotide
  misc_feature (34)..(36): n is a, c, g, or t
tgcaggaccagagaattcgaatacaacacacacnnnacgtatgcca

SEQ ID NO: 6536 - DNA, 46 bp, Artificial Sequence
  Synthesized adaptor oligonucleotide
  misc_feature (34)..(36): n is a, c, g, or t
tgcaggaccagagaattcgaatacatcacgcaannnacgtatgcca

SEQ ID NO: 6537 - DNA, 46 bp, Artificial Sequence
  Synthesized adaptor oligonucleotide
  misc_feature (34)..(36): n is a, c, g, or t
tgcaggaccagagaattcgaatacatcgtactcnnnacgtatgcca

SEQ ID NO: 6538 - DNA, 46 bp, Artificial Sequence
  Synthesized adaptor oligonucleotide
  misc_feature (34)..(36): n is a, c, g, or t
tgcaggaccagagaattcgaatacattcagacgnnnacgtatgcca

SEQ ID NO: 6539 - DNA, 46 bp, Artificial Sequence
  Synthesized adaptor oligonucleotide
  misc_feature (34)..(36): n is a, c, g, or t
tgcaggaccagagaattcgaatacagcgcacgtnnnacgtatgcca

SEQ ID NO: 6540 - DNA, 46 bp, Artificial Sequence
  Synthesized adaptor oligonucleotide
  misc_feature (34)..(36): n is a, c, g, or t
tgcaggaccagagaattcgaatacaccagacatnnnacgtatgcca

SEQ ID NO: 6541 - DNA, 46 bp, Artificial Sequence
  Synthesized adaptor oligonucleotide
  misc_feature (34)..(36): n is a, c, g, or t
tgcaggaccagagaattcgaatacatattgatgnnnacgtatgcca

SEQ ID NO: 6542 - DNA, 46 bp, Artificial Sequence
  Synthesized adaptor oligonucleotide
  misc_feature (34)..(36): n is a, c, g, or t
tgcaggaccagagaattcgaatacacgagatagnnnacgtatgcca

SEQ ID NO: 6543 - DNA, 46 bp, Artificial Sequence
  Synthesized adaptor oligonucleotide
  misc_feature (34)..(36): n is a, c, g, or t
tgcaggaccagagaattcgaatacaatacgaaannnacgtatgcca

SEQ ID NO: 6544 - DNA, 46 bp, Artificial Sequence
  Synthesized adaptor oligonucleotide
  misc_feature (34)..(36): n is a, c, g, or t
tgcaggaccagagaattcgaatacagatgagacnnnacgtatgcca

SEQ ID NO: 6545 - DNA, 46 bp, Artificial Sequence
  Synthesized adaptor oligonucleotide
  misc_feature (34)..(36): n is a, c, g, or t
tgcaggaccagagaattcgaatacatacaatcannnacgtatgcca

SEQ ID NO: 6546 - DNA, 46 bp, Artificial Sequence
  Synthesized adaptor oligonucleotide
  misc_feature (34)..(36): n is a, c, g, or t
tgcaggaccagagaattcgaatacatttaataannnacgtatgcca

SEQ ID NO: 6547 - DNA, 46 bp, Artificial Sequence
  Synthesized adaptor oligonucleotide
  misc_feature (34)..(36): n is a, c, g, or t
tgcaggaccagagaattcgaatacagcgcgtcannnacgtatgcca

SEQ ID NO: 6548 - DNA, 46 bp, Artificial Sequence
  Synthesized adaptor oligonucleotide
  misc_feature (34)..(36): n is a, c, g, or t
tgcaggaccagagaattcgaatacacgatgatcnnnacgtatgcca

SEQ ID NO: 6549 - DNA, 46 bp, Artificial Sequence
  Synthesized adaptor oligonucleotide
  misc_feature (34)..(36): n is a, c, g, or t
tgcaggaccagagaattcgaatacaccgaagccnnnctagcgttac

SEQ ID NO: 6550 - DNA, 46 bp, Artificial Sequence
  Synthesized adaptor oligonucleotide
  misc_feature (34)..(36): n is a, c, g, or t
tgcaggaccagagaattcgaatacaccaaacacnnnctagcgttac

SEQ ID NO: 6551 - DNA, 46 bp, Artificial Sequence
  Synthesized adaptor oligonucleotide
  misc_feature (34)..(36): n is a, c, g, or t
tgcaggaccagagaattcgaatacaggtcttctnnnctagcgttac

SEQ ID NO: 6552 - DNA, 46 bp, Artificial Sequence
  Synthesized adaptor oligonucleotide
  misc_feature (34)..(36): n is a, c, g, or t
tgcaggaccagagaattcgaatacacctcggtcnnnctagcgttac

SEQ ID NO: 6553 - DNA, 46 bp, Artificial Sequence
  Synthesized adaptor oligonucleotide
  misc_feature (34)..(36): n is a, c, g, or t
tgcaggaccagagaattcgaatacaccgctggannnctagcgttac

SEQ ID NO: 6554 - DNA, 46 bp, Artificial Sequence
  Synthesized adaptor oligonucleotide
  misc_feature (34)..(36): n is a, c, g, or t
tgcaggaccagagaattcgaatacaaccaccttnnnctagcgttac

SEQ ID NO: 6555 - DNA, 46 bp, Artificial Sequence
  Synthesized adaptor oligonucleotide
  misc_feature (34)..(36): n is a, c, g, or t
tgcaggaccagagaattcgaatacatctaagtannnctagcgttac

SEQ ID NO: 6556 - DNA, 46 bp, Artificial Sequence
  Synthesized adaptor oligonucleotide
  misc_feature (34)..(36): n is a, c, g, or t
tgcaggaccagagaattcgaatacaattataatnnnctagcgttac

SEQ ID NO: 6557 - DNA, 46 bp, Artificial Sequence
  Synthesized adaptor oligonucleotide
  misc_feature (34)..(36): n is a, c, g, or t
tgcaggaccagagaattcgaatacatggaccgcnnnctagcgttac

SEQ ID NO: 6558 - DNA, 46 bp, Artificial Sequence
  Synthesized adaptor oligonucleotide
  misc_feature (34)..(36): n is a, c, g, or t
tgcaggaccagagaattcgaatacacttcattannnctagcgttac

SEQ ID NO: 6559 - DNA, 46 bp, Artificial Sequence
  Synthesized adaptor oligonucleotide
  misc_feature (34)..(36): n is a, c, g, or t
tgcaggaccagagaattcgaatacaacgcactannnctagcgttac

SEQ ID NO: 6560 - DNA, 46 bp, Artificial Sequence
  Synthesized adaptor oligonucleotide
  misc_feature (34)..(36): n is a, c, g, or t
tgcaggaccagagaattcgaatacatcatggcannnctagcgttac

SEQ ID NO: 6561 - DNA, 46 bp, Artificial Sequence
  Synthesized adaptor oligonucleotide
  misc_feature (34)..(36): n is a, c, g, or t
tgcaggaccagagaattcgaatacaggcttaacnnnctagcgttac

SEQ ID NO: 6562 - DNA, 46 bp, Artificial Sequence
  Synthesized adaptor oligonucleotide
  misc_feature (34)..(36): n is a, c, g, or t
tgcaggaccagagaattcgaatacaatggtattnnnctagcgttac

SEQ ID NO: 6563 - DNA, 46 bp, Artificial Sequence
  Synthesized adaptor oligonucleotide
  misc_feature (34)..(36): n is a, c, g, or t
tgcaggaccagagaattcgaatacagtatgctgnnnctagcgttac

SEQ ID NO: 6564 - DNA, 46 bp, Artificial Sequence
  Synthesized adaptor oligonucleotide
  misc_feature (34)..(36): n is a, c, g, or t
tgcaggaccagagaattcgaatacaatcgtggtnnnctagcgttac

SEQ ID NO: 6565 - DNA, 46 bp, Artificial Sequence
  Synthesized adaptor oligonucleotide
  misc_feature (34)..(36): n is a, c, g, or t
tgcaggaccagagaattcgaatacagcttaggtnnnctagcgttac

SEQ ID NO: 6566 - DNA, 46 bp, Artificial Sequence
  Synthesized adaptor oligonucleotide
  misc_feature (34)..(36): n is a, c, g, or t
tgcaggaccagagaattcgaatacatctgtattnnnctagcgttac

SEQ ID NO: 6567 - DNA, 46 bp, Artificial Sequence
  Synthesized adaptor oligonucleotide
  misc_feature (34)..(36): n is a, c, g, or t
tgcaggaccagagaattcgaatacaggatagcannnctagcgttac

SEQ ID NO: 6568 - DNA, 46 bp, Artificial Sequence
  Synthesized adaptor oligonucleotide
  misc_feature (34)..(36): n is a, c, g, or t
tgcaggaccagagaattcgaatacattcactcgnnnctagcgttac

SEQ ID NO: 6569 - DNA, 46 bp, Artificial Sequence
  Synthesized adaptor oligonucleotide
  misc_feature (34)..(36): n is a, c, g, or t
tgcaggaccagagaattcgaatacattcggacannnctagcgttac

SEQ ID NO: 6570 - DNA, 46 bp, Artificial Sequence
  Synthesized adaptor oligonucleotide
  misc_feature (34)..(36): n is a, c, g, or t
tgcaggaccagagaattcgaatacacggtcggtnnnctagcgttac

SEQ ID NO: 6571 - DNA, 46 bp, Artificial Sequence
  Synthesized adaptor oligonucleotide
  misc_feature (34)..(36): n is a, c, g, or t
tgcaggaccagagaattcgaatacaagatcgctnnnctagcgttac

SEQ ID NO: 6572 - DNA, 46 bp, Artificial Sequence
  Synthesized adaptor oligonucleotide
  misc_feature (34)..(36): n is a, c, g, or t
tgcaggaccagagaattcgaatacagcattcgannnctagcgttac

SEQ ID NO: 6573 - DNA, 46 bp, Artificial Sequence
  Synthesized adaptor oligonucleotide
  misc_feature (34)..(36): n is a, c, g, or t
tgcaggaccagagaattcgaatacacgctgatannnctagcgttac

SEQ ID NO: 6574 - DNA, 46 bp, Artificial Sequence
  Synthesized adaptor oligonucleotide
  misc_feature (34)..(36): n is a, c, g, or t
tgcaggaccagagaattcgaatacacggttaacnnnctagcgttac

SEQ ID NO: 6575 - DNA, 46 bp, Artificial Sequence
  Synthesized adaptor oligonucleotide
  misc_feature (34)..(36): n is a, c, g, or t
tgcaggaccagagaattcgaatacaaatgtcatnnnctagcgttac

SEQ ID NO: 6576 - DNA, 46 bp, Artificial Sequence
  Synthesized adaptor oligonucleotide
  misc_feature (34)..(36): n is a, c, g, or t
tgcaggaccagagaattcgaatacagcaagacannnctagcgttac

SEQ ID NO: 6577 - DNA, 46 bp, Artificial Sequence
  Synthesized adaptor oligonucleotide
  misc_feature (34)..(36): n is a, c, g, or t
tgcaggaccagagaattcgaatacaccagcctcnnnctagcgttac

SEQ ID NO: 6578 - DNA, 46 bp, Artificial Sequence
  Synthesized adaptor oligonucleotide
  misc_feature (34)..(36): n is a, c, g, or t
tgcaggaccagagaattcgaatacacttgttcgnnnctagcgttac

SEQ ID NO: 6579 - DNA, 46 bp, Artificial Sequence
  Synthesized adaptor oligonucleotide
  misc_feature (34)..(36): n is a, c, g, or t
tgcaggaccagagaattcgaatacatatcggtgnnnctagcgttac

SEQ ID NO: 6580 - DNA, 46 bp, Artificial Sequence
  Synthesized adaptor oligonucleotide
  misc_feature (34)..(36): n is a, c, g, or t
tgcaggaccagagaattcgaatacactggcatannnctagcgttac

SEQ ID NO: 6581 - DNA, 46 bp, Artificial Sequence
  Synthesized adaptor oligonucleotide
  misc_feature (34)..(36): n is a, c, g, or t
tgcaggaccagagaattcgaatacatgcaggccnnnctagcgttac

SEQ ID NO: 6582 - DNA, 46 bp, Artificial Sequence
  Synthesized adaptor oligonucleotide
  misc_feature (34)..(36): n is a, c, g, or t
tgcaggaccagagaattcgaatacattcctcctnnnctagcgttac

SEQ ID NO: 6583 - DNA, 46 bp, Artificial Sequence
  Synthesized adaptor oligonucleotide
  misc_feature (34)..(36): n is a, c, g, or t
tgcaggaccagagaattcgaatacataacggagnnnctagcgttac

SEQ ID NO: 6584 - DNA, 46 bp, Artificial Sequence
  Synthesized adaptor oligonucleotide
  misc_feature (34)..(36): n is a, c, g, or t
tgcaggaccagagaattcgaatacagagtggatnnnctagcgttac

SEQ ID NO: 6585 - DNA, 46 bp, Artificial Sequence
  Synthesized adaptor oligonucleotide
  misc_feature (34)..(36): n is a, c, g, or t
tgcaggaccagagaattcgaatacatcgtaaatnnnctagcgttac

SEQ ID NO: 6586 - DNA, 46 bp, Artificial Sequence
  Synthesized adaptor oligonucleotide
  misc_feature (34)..(36): n is a, c, g, or t
tgcaggaccagagaattcgaatacacaacgactnnnctagcgttac

SEQ ID NO: 6587 - DNA, 46 bp, Artificial Sequence
  Synthesized adaptor oligonucleotide
  misc_feature (34)..(36): n is a, c, g, or t
tgcaggaccagagaattcgaatacagcacccctnnnctagcgttac

SEQ ID NO: 6588 - DNA, 46 bp, Artificial Sequence
  Synthesized adaptor oligonucleotide
  misc_feature (34)..(36): n is a, c, g, or t
tgcaggaccagagaattcgaatacagataattcnnnctagcgttac

SEQ ID NO: 6589 - DNA, 46 bp, Artificial Sequence
  Synthesized adaptor oligonucleotide
  misc_feature (34)..(36): n is a, c, g, or t
tgcaggaccagagaattcgaatacaaactcaatnnnctagcgttac

SEQ ID NO: 6590 - DNA, 46 bp, Artificial Sequence
  Synthesized adaptor oligonucleotide
  misc_feature (34)..(36): n is a, c, g, or t
tgcaggaccagagaattcgaatacatcaaaactnnnctagcgttac

SEQ ID NO: 6591 - DNA, 46 bp, Artificial Sequence
  Synthesized adaptor oligonucleotide
  misc_feature (34)..(36): n is a, c, g, or t
tgcaggaccagagaattcgaatacaattattccnnnctagcgttac

SEQ ID NO: 6592 - DNA, 46 bp, Artificial Sequence
  Synthesized adaptor oligonucleotide
  misc_feature (34)..(36): n is a, c, g, or t
tgcaggaccagagaattcgaatacacttcttggnnnctagcgttac

SEQ ID NO: 6593 - DNA, 46 bp, Artificial Sequence
  Synthesized adaptor oligonucleotide
  misc_feature (34)..(36): n is a, c, g, or t
tgcaggaccagagaattcgaatacataagtaagnnnctagcgttac

SEQ ID NO: 6594 - DNA, 46 bp, Artificial Sequence
  Synthesized adaptor oligonucleotide
  misc_feature (34)..(36): n is a, c, g, or t
tgcaggaccagagaattcgaatacactaaccctnnnctagcgttac

SEQ ID NO: 6595 - DNA, 46 bp, Artificial Sequence
  Synthesized adaptor oligonucleotide
  misc_feature (34)..(36): n is a, c, g, or t
tgcaggaccagagaattcgaatacaatagcgtcnnnctagcgttac

SEQ ID NO: 6596 - DNA, 46 bp, Artificial Sequence
  Synthesized adaptor oligonucleotide
  misc_feature (34)..(36): n is a, c, g, or t
tgcaggaccagagaattcgaatacaaaggtaatnnnctagcgttac

SEQ ID NO: 6597 - DNA, 46 bp, Artificial Sequence
  Synthesized adaptor oligonucleotide
  misc_feature (34)..(36): n is a, c, g, or t
tgcaggaccagagaattcgaatacatcacgtagnnnctagcgttac

SEQ ID NO: 6598 - DNA, 46 bp, Artificial Sequence
  Synthesized adaptor oligonucleotide
  misc_feature (34)..(36): n is a, c, g, or t
tgcaggaccagagaattcgaatacaaaccatatnnnctagcgttac

SEQ ID NO: 6599 - DNA, 46 bp, Artificial Sequence
  Synthesized adaptor oligonucleotide
  misc_feature (34)..(36): n is a, c, g, or t
tgcaggaccagagaattcgaatacagacgagtannnctagcgttac

SEQ ID NO: 6600 - DNA, 46 bp, Artificial Sequence
  Synthesized adaptor oligonucleotide
  misc_feature (34)..(36): n is a, c, g, or t
tgcaggaccagagaattcgaatacaataaatttnnnctagcgttac

SEQ ID NO: 6601 - DNA, 46 bp, Artificial Sequence
  Synthesized adaptor oligonucleotide
  misc_feature (34)..(36): n is a, c, g, or t
tgcaggaccagagaattcgaatacagagctaagnnnctagcgttac

SEQ ID NO: 6602 - DNA, 46 bp, Artificial Sequence
  Synthesized adaptor oligonucleotide
  misc_feature (34)..(36): n is a, c, g, or t
tgcaggaccagagaattcgaatacagcggatccnnnctagcgttac

SEQ ID NO: 6603 - DNA, 46 bp, Artificial Sequence
  Synthesized adaptor oligonucleotide
  misc_feature (34)..(36): n is a, c, g, or t
tgcaggaccagagaattcgaatacattcatagannnctagcgttac

SEQ ID NO: 6604 - DNA, 46 bp, Artificial Sequence
  Synthesized adaptor oligonucleotide
  misc_feature (34)..(36): n is a, c, g, or t
tgcaggaccagagaattcgaatacattaagcatnnnctagcgttac

SEQ ID NO: 6605 - DNA, 46 bp, Artificial Sequence
  Synthesized adaptor oligonucleotide
  misc_feature (34)..(36): n is a, c, g, or t
tgcaggaccagagaattcgaatacatcgagcgcnnnctagcgttac

SEQ ID NO: 6606 - DNA, 46 bp, Artificial Sequence
  Synthesized adaptor oligonucleotide
  misc_feature (34)..(36): n is a, c, g, or t
tgcaggaccagagaattcgaatacatcgcacccnnnctagcgttac

SEQ ID NO: 6607 - DNA, 46 bp, Artificial Sequence
  Synthesized adaptor oligonucleotide
  misc_feature (34)..(36): n is a, c, g, or t
tgcaggaccagagaattcgaatacacttggacannnctagcgttac

SEQ ID NO: 6608 - DNA, 46 bp, Artificial Sequence
  Synthesized adaptor oligonucleotide
  misc_feature (34)..(36): n is a, c, g, or t
tgcaggaccagagaattcgaatacattccagtcnnnctagcgttac

SEQ ID NO: 6609 - DNA, 46 bp, Artificial Sequence
  Synthesized adaptor oligonucleotide
  misc_feature (34)..(36): n is a, c, g, or t
tgcaggaccagagaattcgaatacagtttttacnnngatcgacatg

SEQ ID NO: 6610 - DNA, 46 bp, Artificial Sequence
  Synthesized adaptor oligonucleotide
  misc_feature (34)..(36): n is a, c, g, or t
tgcaggaccagagaattcgaatacaaacttagtnnngatcgacatg

SEQ ID NO: 6611 - DNA, 46 bp, Artificial Sequence
  Synthesized adaptor oligonucleotide
  misc_feature (34)..(36): n is a, c, g, or t
tgcaggaccagagaattcgaatacacgcgcgcgnnngatcgacatg

SEQ ID NO: 6612 - DNA, 46 bp, Artificial Sequence
  Synthesized adaptor oligonucleotide
  misc_feature (34)..(36): n is a, c, g, or t
tgcaggaccagagaattcgaatacaaactgttannngatcgacatg

SEQ ID NO: 6613 - DNA, 46 bp, Artificial Sequence
  Synthesized adaptor oligonucleotide
  misc_feature (34)..(36): n is a, c, g, or t
tgcaggaccagagaattcgaatacagtaagtttnnngatcgacatg

SEQ ID NO: 6614 - DNA, 46 bp, Artificial Sequence
  Synthesized adaptor oligonucleotide
  misc_feature (34)..(36): n is a, c, g, or t
tgcaggaccagagaattcgaatacacttagcagnnngatcgacatg

SEQ ID NO: 6615 - DNA, 46 bp, Artificial Sequence
  Synthesized adaptor oligonucleotide
  misc_feature (34)..(36): n is a, c, g, or t
tgcaggaccagagaattcgaatacaactttccgnnngatcgacatg

SEQ ID NO: 6616 - DNA, 46 bp, Artificial Sequence
  Synthesized adaptor oligonucleotide
  misc_feature (34)..(36): n is a, c, g, or t
tgcaggaccagagaattcgaatacactcctcttnnngatcgacatg

SEQ ID NO: 6617 - DNA, 46 bp, Artificial Sequence
  Synthesized adaptor oligonucleotide
  misc_feature (34)..(36): n is a, c, g, or t
tgcaggaccagagaattcgaatacaagataatgnnngatcgacatg

SEQ ID NO: 6618 - DNA, 46 bp, Artificial Sequence
  Synthesized adaptor oligonucleotide
  misc_feature (34)..(36): n is a, c, g, or t
tgcaggaccagagaattcgaatacacagccctcnnngatcgacatg

SEQ ID NO: 6619 - DNA, 46 bp, Artificial Sequence
  Synthesized adaptor oligonucleotide
  misc_feature (34)..(36): n is a, c, g, or t
tgcaggaccagagaattcgaatacacgtaattannngatcgacatg

SEQ ID NO: 6620 - DNA, 46 bp, Artificial Sequence
  Synthesized adaptor oligonucleotide
  misc_feature (34)..(36): n is a, c, g, or t
tgcaggaccagagaattcgaatacagttcgttcnnngatcgacatg

SEQ ID NO: 6621 - DNA, 46 bp, Artificial Sequence
  Synthesized adaptor oligonucleotide
  misc_feature (34)..(36): n is a, c, g, or t
tgcaggaccagagaattcgaatacattccgtcannngatcgacatg

SEQ ID NO: 6622 - DNA, 46 bp, Artificial Sequence
  Synthesized adaptor oligonucleotide
  misc_feature (34)..(36): n is a, c, g, or t
tgcaggaccagagaattcgaatacaacgacgttnnngatcgacatg

SEQ ID NO: 6623 - DNA, 46 bp, Artificial Sequence
  Synthesized adaptor oligonucleotide
  misc_feature (34)..(36): n is a, c, g, or t
tgcaggaccagagaattcgaatacaaagtagcgnnngatcgacatg

SEQ ID NO: 6624 - DNA, 46 bp, Artificial Sequence
  Synthesized adaptor oligonucleotide
  misc_feature (34)..(36): n is a, c, g, or t
tgcaggaccagagaattcgaatacaagtgaagcnnngatcgacatg

SEQ ID NO: 6625 - DNA, 46 bp, Artificial Sequence
  Synthesized adaptor oligonucleotide
  misc_feature (34)..(36): n is a, c, g, or t
tgcaggaccagagaattcgaatacattctcatannngatcgacatg

SEQ ID NO: 6626 - DNA, 46 bp, Artificial Sequence
  Synthesized adaptor oligonucleotide
  misc_feature (34)..(36): n is a, c, g, or t
tgcaggaccagagaattcgaatacaagtagagcnnngatcgacatg

SEQ ID NO: 6627 - DNA, 46 bp, Artificial Sequence
  Synthesized adaptor oligonucleotide
  misc_feature (34)..(36): n is a, c, g, or t
tgcaggaccagagaattcgaatacatcccgattnnngatcgacatg

SEQ ID NO: 6628 - DNA, 46 bp, Artificial Sequence
  Synthesized adaptor oligonucleotide
  misc_feature (34)..(36): n is a, c, g, or t
tgcaggaccagagaattcgaatacacaaggtctnnngatcgacatg

SEQ ID NO: 6629 - DNA, 46 bp, Artificial Sequence
  Synthesized adaptor oligonucleotide
  misc_feature (34)..(36): n is a, c, g, or t
tgcaggaccagagaattcgaatacagagtatggnnngatcgacatg

SEQ ID NO: 6630 - DNA, 46 bp, Artificial Sequence
  Synthesized adaptor oligonucleotide
  misc_feature (34)..(36): n is a, c, g, or t
tgcaggaccagagaattcgaatacaccgcagtgnnngatcgacatg

SEQ ID NO: 6631 - DNA, 46 bp, Artificial Sequence
  Synthesized adaptor oligonucleotide
  misc_feature (34)..(36): n is a, c, g, or t
tgcaggaccagagaattcgaatacagaagctctnnngatcgacatg

SEQ ID NO: 6632 - DNA, 46 bp, Artificial Sequence
  Synthesized adaptor oligonucleotide
  misc_feature (34)..(36): n is a, c, g, or t
tgcaggaccagagaattcgaatacagtgcaagannngatcgacatg

SEQ ID NO: 6633 - DNA, 46 bp, Artificial Sequence
  Synthesized adaptor oligonucleotide
  misc_feature (34)..(36): n is a, c, g, or t
tgcaggaccagagaattcgaatacaaacggtagnnngatcgacatg

SEQ ID NO: 6634 - DNA, 46 bp, Artificial Sequence
  Synthesized adaptor oligonucleotide
  misc_feature (34)..(36): n is a, c, g, or t
tgcaggaccagagaattcgaatacacttcgactnnngatcgacatg

SEQ ID NO: 6635 - DNA, 46 bp, Artificial Sequence
  Synthesized adaptor oligonucleotide
  misc_feature (34)..(36): n is a, c, g, or t
tgcaggaccagagaattcgaatacaccgacgacnnngatcgacatg

SEQ ID NO: 6636 - DNA, 46 bp, Artificial Sequence
  Synthesized adaptor oligonucleotide
  misc_feature (34)..(36): n is a, c, g, or t
tgcaggaccagagaattcgaatacactacactcnnngatcgacatg

SEQ ID NO: 6637 - DNA, 46 bp, Artificial Sequence
  Synthesized adaptor oligonucleotide
  misc_feature (34)..(36): n is a, c, g, or t
tgcaggaccagagaattcgaatacaagctaaggnnngatcgacatg

SEQ ID NO: 6638 - DNA, 46 bp, Artificial Sequence
  Synthesized adaptor oligonucleotide
  misc_feature (34)..(36): n is a, c, g, or t
tgcaggaccagagaattcgaatacagagtatccnnngatcgacatg

SEQ ID NO: 6639 - DNA, 46 bp, Artificial Sequence
  Synthesized adaptor oligonucleotide
  misc_feature (34)..(36): n is a, c, g, or t
tgcaggaccagagaattcgaatacatcctaccannngatcgacatg

SEQ ID NO: 6640 - DNA, 46 bp, Artificial Sequence
  Synthesized adaptor oligonucleotide
  misc_feature (34)..(36): n is a, c, g, or t
tgcaggaccagagaattcgaatacatttttctcnnngatcgacatg

SEQ ID NO: 6641 - DNA, 46 bp, Artificial Sequence
  Synthesized adaptor oligonucleotide
  misc_feature (34)..(36): n is a, c, g, or t
tgcaggaccagagaattcgaatacacggataagnnngatcgacatg

SEQ ID NO: 6642 - DNA, 46 bp, Artificial Sequence
  Synthesized adaptor oligonucleotide
  misc_feature (34)..(36): n is a, c, g, or t
tgcaggaccagagaattcgaatacacaaatcgcnnngatcgacatg

SEQ ID NO: 6643 - DNA, 46 bp, Artificial Sequence
  Synthesized adaptor oligonucleotide
  misc_feature (34)..(36): n is a, c, g, or t
tgcaggaccagagaattcgaatacagtgtcggcnnngatcgacatg

SEQ ID NO: 6644 - DNA, 46 bp, Artificial Sequence
  Synthesized adaptor oligonucleotide
  misc_feature (34)..(36): n is a, c, g, or t
tgcaggaccagagaattcgaatacaaagctattnnngatcgacatg

SEQ ID NO: 6645 - DNA, 46 bp, Artificial Sequence
  Synthesized adaptor oligonucleotide
  misc_feature (34)..(36): n is a, c, g, or t
tgcaggaccagagaattcgaatacaaccggaccnnngatcgacatg

SEQ ID NO: 6646 - DNA, 46 bp, Artificial Sequence
  Synthesized adaptor oligonucleotide
  misc_feature (34)..(36): n is a, c, g, or t
tgcaggaccagagaattcgaatacattaaatgcnnngatcgacatg

SEQ ID NO: 6647 - DNA, 46 bp, Artificial Sequence
  Synthesized adaptor oligonucleotide
  misc_feature (34)..(36): n is a, c, g, or t
tgcaggaccagagaattcgaatacactgcaagtnnngatcgacatg

SEQ ID NO: 6648 - DNA, 46 bp, Artificial Sequence
  Synthesized adaptor oligonucleotide
  misc_feature (34)..(36): n is a, c, g, or t
tgcaggaccagagaattcgaatacacccttaacnnngatcgacatg

SEQ ID NO: 6649 - DNA, 46 bp, Artificial Sequence
  Synthesized adaptor oligonucleotide
  misc_feature (34)..(36): n is a, c, g, or t
tgcaggaccagagaattcgaatacaagtgagacnnngatcgacatg

SEQ ID NO: 6650 - DNA, 46 bp, Artificial Sequence
  Synthesized adaptor oligonucleotide
  misc_feature (34)..(36): n is a, c, g, or t
tgcaggaccagagaattcgaatacatattagacnnngatcgacatg

SEQ ID NO: 6651 - DNA, 46 bp, Artificial Sequence
  Synthesized adaptor oligonucleotide
  misc_feature (34)..(36): n is a, c, g, or t
tgcaggaccagagaattcgaatacagttggctannngatcgacatg

SEQ ID NO: 6652 - DNA, 46 bp, Artificial Sequence
  Synthesized adaptor oligonucleotide
  misc_feature (34)..(36): n is a, c, g, or t
tgcaggaccagagaattcgaatacatcgctaagnnngatcgacatg

SEQ ID NO: 6653 - DNA, 46 bp, Artificial Sequence
  Synthesized adaptor oligonucleotide
  misc_feature (34)..(36): n is a, c, g, or t
tgcaggaccagagaattcgaatacaagcccctcnnngatcgacatg

SEQ ID NO: 6654 - DNA, 46 bp, Artificial Sequence
  Synthesized adaptor oligonucleotide
  misc_feature (34)..(36): n is a, c, g, or t
tgcaggaccagagaattcgaatacattacgaatnnngatcgacatg

SEQ ID NO: 6655 - DNA, 46 bp, Artificial Sequence
  Synthesized adaptor oligonucleotide
  misc_feature (34)..(36): n is a, c, g, or t
tgcaggaccagagaattcgaatacaggccaccannngatcgacatg

SEQ ID NO: 6656 - DNA, 46 bp, Artificial Sequence
  Synthesized adaptor oligonucleotide
  misc_feature (34)..(36): n is a, c, g, or t
tgcaggaccagagaattcgaatacatccttatannngatcgacatg

SEQ ID NO: 6657 - DNA, 46 bp, Artificial Sequence
  Synthesized adaptor oligonucleotide
  misc_feature (34)..(36): n is a, c, g, or t
tgcaggaccagagaattcgaatacatcagtctcnnngatcgacatg

SEQ ID NO: 6658 - DNA, 46 bp, Artificial Sequence
  Synthesized adaptor oligonucleotide
  misc_feature (34)..(36): n is a, c, g, or t
tgcaggaccagagaattcgaatacacgacttctnnngatcgacatg

SEQ ID NO: 6659 - DNA, 46 bp, Artificial Sequence
  Synthesized adaptor oligonucleotide
  misc_feature (34)..(36): n is a, c, g, or t
tgcaggaccagagaattcgaatacaaggtaacgnnngatcgacatg

SEQ ID NO: 6660 - DNA, 46 bp, Artificial Sequence
  Synthesized adaptor oligonucleotide
  misc_feature (34)..(36): n is a, c, g, or t
tgcaggaccagagaattcgaatacaagacactcnnngatcgacatg

SEQ ID NO: 6661 - DNA, 46 bp, Artificial Sequence
  Synthesized adaptor oligonucleotide
  misc_feature (34)..(36): n is a, c, g, or t
tgcaggaccagagaattcgaatacaggcttcggnnngatcgacatg

SEQ ID NO: 6662 - DNA, 46 bp, Artificial Sequence
  Synthesized adaptor oligonucleotide
  misc_feature (34)..(36): n is a, c, g, or t
tgcaggaccagagaattcgaatacacaattcggnnngatcgacatg

SEQ ID NO: 6663 - DNA, 46 bp, Artificial Sequence
  Synthesized adaptor oligonucleotide
  misc_feature (34)..(36): n is a, c, g, or t
tgcaggaccagagaattcgaatacaggctctggnnngatcgacatg

SEQ ID NO: 6664 - DNA, 46 bp, Artificial Sequence
  Synthesized adaptor oligonucleotide
  misc_feature (34)..(36): n is a, c, g, or t
tgcaggaccagagaattcgaatacatctctgacnnngatcgacatg

SEQ ID NO: 6665 - DNA, 46 bp, Artificial Sequence
  Synthesized adaptor oligonucleotide
  misc_feature (34)..(36): n is a, c, g, or t
tgcaggaccagagaattcgaatacagagtaggtnnngatcgacatg

SEQ ID NO: 6666 - DNA, 46 bp, Artificial Sequence
  Synthesized adaptor oligonucleotide
  misc_feature (34)..(36): n is a, c, g, or t
tgcaggaccagagaattcgaatacaattttttannngatcgacatg

SEQ ID NO: 6667 - DNA, 46 bp, Artificial Sequence
  Synthesized adaptor oligonucleotide
  misc_feature (34)..(36): n is a, c, g, or t
tgcaggaccagagaattcgaatacaatttctacnnngatcgacatg

SEQ ID NO: 6668 - DNA, 46 bp, Artificial Sequence
  Synthesized adaptor oligonucleotide
  misc_feature (34)..(36): n is a, c, g, or t
tgcaggaccagagaattcgaatacaaacgctgtnnngatcgacatg

SEQ ID NO: 6669 - DNA, 46 bp, Artificial Sequence
  Synthesized adaptor oligonucleotide
  misc_feature (34)..(36): n is a, c, g, or t
tgcaggaccagagaattcgaatacaatcgactgnnntgcatcaggt

SEQ ID NO: 6670 - DNA, 46 bp, Artificial Sequence
  Synthesized adaptor oligonucleotide
  misc_feature (34)..(36): n is a, c, g, or t
tgcaggaccagagaattcgaatacataacgattnnntgcatcaggt

SEQ ID NO: 6671 - DNA, 46 bp, Artificial Sequence
  Synthesized adaptor oligonucleotide
  misc_feature (34)..(36): n is a, c, g, or t
tgcaggaccagagaattcgaatacagcccagcannntgcatcaggt

SEQ ID NO: 6672 - DNA, 46 bp, Artificial Sequence
  Synthesized adaptor oligonucleotide
  misc_feature (34)..(36): n is a, c, g, or t
tgcaggaccagagaattcgaatacaacaaacggnnntgcatcaggt

SEQ ID NO: 6673 - DNA, 46 bp, Artificial Sequence
  Synthesized adaptor oligonucleotide
  misc_feature (34)..(36): n is a, c, g, or t
tgcaggaccagagaattcgaatacaagagtgcannntgcatcaggt

SEQ ID NO: 6674 - DNA, 46 bp, Artificial Sequence
  Synthesized adaptor oligonucleotide
  misc_feature (34)..(36): n is a, c, g, or t
tgcaggaccagagaattcgaatacacggatcgcnnntgcatcaggt

SEQ ID NO: 6675 - DNA, 46 bp, Artificial Sequence
  Synthesized adaptor oligonucleotide
  misc_feature (34)..(36): n is a, c, g, or t
tgcaggaccagagaattcgaatacaggaatcctnnntgcatcaggt

SEQ ID NO: 6676 - DNA, 46 bp, Artificial Sequence
  Synthesized adaptor oligonucleotide
  misc_feature (34)..(36): n is a, c, g, or t
tgcaggaccagagaattcgaatacaacctaaatnnntgcatcaggt

SEQ ID NO: 6677 - DNA, 46 bp, Artificial Sequence
  Synthesized adaptor oligonucleotide
  misc_feature (34)..(36): n is a, c, g, or t
tgcaggaccagagaattcgaatacacgtatcgannntgcatcaggt

SEQ ID NO: 6678 - DNA, 46 bp, Artificial Sequence
  Synthesized adaptor oligonucleotide
  misc_feature (34)..(36): n is a, c, g, or t
tgcaggaccagagaattcgaatacatcagatatnnntgcatcaggt

SEQ ID NO: 6679 - DNA, 46 bp, Artificial Sequence
  Synthesized adaptor oligonucleotide
  misc_feature (34)..(36): n is a, c, g, or t
tgcaggaccagagaattcgaatacagcgaccgtnnntgcatcaggt

SEQ ID NO: 6680 - DNA, 46 bp, Artificial Sequence
  Synthesized adaptor oligonucleotide
  misc_feature (34)..(36): n is a, c, g, or t
tgcaggaccagagaattcgaatacatcagactgnnntgcatcaggt

SEQ ID NO: 6681 - DNA, 46 bp, Artificial Sequence
  Synthesized adaptor oligonucleotide
  misc_feature (34)..(36): n is a, c, g, or t
tgcaggaccagagaattcgaatacaatgcacgtnnntgcatcaggt

SEQ ID NO: 6682 - DNA, 46 bp, Artificial Sequence
  Synthesized adaptor oligonucleotide
  misc_feature (34)..(36): n is a, c, g, or t
tgcaggaccagagaattcgaatacatctactgcnnntgcatcaggt

SEQ ID NO: 6683 - DNA, 46 bp, Artificial Sequence
  Synthesized adaptor oligonucleotide
  misc_feature (34)..(36): n is a, c, g, or t
tgcaggaccagagaattcgaatacactcgttgtnnntgcatcaggt

SEQ ID NO: 6684 - DNA, 46 bp, Artificial Sequence
  Synthesized adaptor oligonucleotide
  misc_feature (34)..(36): n is a, c, g, or t
tgcaggaccagagaattcgaatacactgtgtagnnntgcatcaggt

SEQ ID NO: 6685 - DNA, 46 bp, Artificial Sequence
  Synthesized adaptor oligonucleotide
  misc_feature (34)..(36): n is a, c, g, or t
tgcaggaccagagaattcgaatacagcttgcttnnntgcatcaggt

SEQ ID NO: 6686 - DNA, 46 bp, Artificial Sequence
  Synthesized adaptor oligonucleotide
  misc_feature (34)..(36): n is a, c, g, or t
tgcaggaccagagaattcgaatacacttttcttnnntgcatcaggt

SEQ ID NO: 6687 - DNA, 46 bp, Artificial Sequence
  Synthesized adaptor oligonucleotide
  misc_feature (34)..(36): n is a, c, g, or t
tgcaggaccagagaattcgaatacatcaactccnnntgcatcaggt

SEQ ID NO: 6688 - DNA, 46 bp, Artificial Sequence
  Synthesized adaptor oligonucleotide
  misc_feature (34)..(36): n is a, c, g, or t
tgcaggaccagagaattcgaatacaatccagcannntgcatcaggt

SEQ ID NO: 6689 - DNA, 46 bp, Artificial Sequence
  Synthesized adaptor oligonucleotide
  misc_feature (34)..(36): n is a, c, g, or t
tgcaggaccagagaattcgaatacaaaccgctannntgcatcaggt

SEQ ID NO: 6690 - DNA, 46 bp, Artificial Sequence
  Synthesized adaptor oligonucleotide
  misc_feature (34)..(36): n is a, c, g, or t
tgcaggaccagagaattcgaatacacgcctgtcnnntgcatcaggt

SEQ ID NO: 6691 - DNA, 46 bp, Artificial Sequence
  Synthesized adaptor oligonucleotide
  misc_feature (34)..(36): n is a, c, g, or t
tgcaggaccagagaattcgaatacataaggcctnnntgcatcaggt

SEQ ID NO: 6692 - DNA, 46 bp, Artificial Sequence
  Synthesized adaptor oligonucleotide
  misc_feature (34)..(36): n is a, c, g, or t
tgcaggaccagagaattcgaatacatgtcatggnnntgcatcaggt

SEQ ID NO: 6693 - DNA, 46 bp, Artificial Sequence
  Synthesized adaptor oligonucleotide
  misc_feature (34)..(36): n is a, c, g, or t
tgcaggaccagagaattcgaatacatagcagtcnnntgcatcaggt

SEQ ID NO: 6694 - DNA, 46 bp, Artificial Sequence
  Synthesized adaptor oligonucleotide
  misc_feature (34)..(36): n is a, c, g, or t
tgcaggaccagagaattcgaatacagcgctgacnnntgcatcaggt

SEQ ID NO: 6695 - DNA, 46 bp, Artificial Sequence
  Synthesized adaptor oligonucleotide
  misc_feature (34)..(36): n is a, c, g, or t
tgcaggaccagagaattcgaatacatatatcctnnntgcatcaggt

SEQ ID NO: 6696 - DNA, 46 bp, Artificial Sequence
  Synthesized adaptor oligonucleotide
  misc_feature (34)..(36): n is a, c, g, or t
tgcaggaccagagaattcgaatacacacgaaagnnntgcatcaggt

SEQ ID NO: 6697 - DNA, 46 bp, Artificial Sequence
  Synthesized adaptor oligonucleotide
  misc_feature (34)..(36): n is a, c, g, or t
tgcaggaccagagaattcgaatacaataagtctnnntgcatcaggt

SEQ ID NO: 6698 - DNA, 46 bp, Artificial Sequence
  Synthesized adaptor oligonucleotide
  misc_feature (34)..(36): n is a, c, g, or t
tgcaggaccagagaattcgaatacagctgtcccnnntgcatcaggt

SEQ ID NO: 6699 - DNA, 46 bp, Artificial Sequence
  Synthesized adaptor oligonucleotide
  misc_feature (34)..(36): n is a, c, g, or t
tgcaggaccagagaattcgaatacaatgacctgnnntgcatcaggt

SEQ ID NO: 6700 - DNA, 46 bp, Artificial Sequence
  Synthesized adaptor oligonucleotide
  misc_feature (34)..(36): n is a, c, g, or t
tgcaggaccagagaattcgaatacaatacccctnnntgcatcaggt

SEQ ID NO: 6701 - DNA, 46 bp, Artificial Sequence
  Synthesized adaptor oligonucleotide
  misc_feature (34)..(36): n is a, c, g, or t
tgcaggaccagagaattcgaatacatgaggtagnnntgcatcaggt

SEQ ID NO: 6702 - DNA, 46 bp, Artificial Sequence
  Synthesized adaptor oligonucleotide
  misc_feature (34)..(36): n is a, c, g, or t
tgcaggaccagagaattcgaatacacgaatctgnnntgcatcaggt

SEQ ID NO: 6703 - DNA, 46 bp, Artificial Sequence
  Synthesized adaptor oligonucleotide
  misc_feature (34)..(36): n is a, c, g, or t
tgcaggaccagagaattcgaatacagccgacgtnnntgcatcaggt

SEQ ID NO: 6704 - DNA, 46 bp, Artificial Sequence
  Synthesized adaptor oligonucleotide
  misc_feature (34)..(36): n is a, c, g, or t
tgcaggaccagagaattcgaatacattcaaacannntgcatcaggt

SEQ ID NO: 6705 - DNA, 46 bp, Artificial Sequence
  Synthesized adaptor oligonucleotide
  misc_feature (34)..(36): n is a, c, g, or t
tgcaggaccagagaattcgaatacaaggcttacnnntgcatcaggt

SEQ ID NO: 6706 - DNA, 46 bp, Artificial Sequence
  Synthesized adaptor oligonucleotide
  misc_feature (34)..(36): n is a, c, g, or t
tgcaggaccagagaattcgaatacaaaaacggcnnntgcatcaggt

SEQ ID NO: 6707 - DNA, 46 bp, Artificial Sequence
  Synthesized adaptor oligonucleotide
  misc_feature (34)..(36): n is a, c, g, or t
tgcaggaccagagaattcgaatacagataggacnnntgcatcaggt

SEQ ID NO: 6708 - DNA, 46 bp, Artificial Sequence
  Synthesized adaptor oligonucleotide
  misc_feature (34)..(36): n is a, c, g, or t
tgcaggaccagagaattcgaatacaatggcgaannntgcatcaggt

SEQ ID NO: 6709 - DNA, 46 bp, Artificial Sequence
  Synthesized adaptor oligonucleotide
  misc_feature (34)..(36): n is a, c, g, or t
tgcaggaccagagaattcgaatacaaccaagagnnntgcatcaggt

SEQ ID NO: 6710 - DNA, 46 bp, Artificial Sequence
  Synthesized adaptor oligonucleotide
  misc_feature (34)..(36): n is a, c, g, or t
tgcaggaccagagaattcgaatacacaaacgctnnntgcatcaggt

SEQ ID NO: 6711 - DNA, 46 bp, Artificial Sequence
  Synthesized adaptor oligonucleotide
  misc_feature (34)..(36): n is a, c, g, or t
tgcaggaccagagaattcgaatacacgctttcannntgcatcaggt

SEQ ID NO: 6712 - DNA, 46 bp, Artificial Sequence
  Synthesized adaptor oligonucleotide
  misc_feature (34)..(36): n is a, c, g, or t
tgcaggaccagagaattcgaatacatccaggcgnnntgcatcaggt

SEQ ID NO: 6713 - DNA, 46 bp, Artificial Sequence
  Synthesized adaptor oligonucleotide
  misc_feature (34)..(36): n is a, c, g, or t
tgcaggaccagagaattcgaatacattgaaatcnnntgcatcaggt

SEQ ID NO: 6714 - DNA, 46 bp, Artificial Sequence
  Synthesized adaptor oligonucleotide
  misc_feature (34)..(36): n is a, c, g, or t
tgcaggaccagagaattcgaatacacctgctgcnnntgcatcaggt

SEQ ID NO: 6715 - DNA, 46 bp, Artificial Sequence
  Synthesized adaptor oligonucleotide
  misc_feature (34)..(36): n is a, c, g, or t
tgcaggaccagagaattcgaatacacgaatgagnnntgcatcaggt

SEQ ID NO: 6716 - DNA, 46 bp, Artificial Sequence
  Synthesized adaptor oligonucleotide
  misc_feature (34)..(36): n is a, c, g, or t
tgcaggaccagagaattcgaatacatgtgttaannntgcatcaggt

SEQ ID NO: 6717 - DNA, 46 bp, Artificial Sequence
  Synthesized adaptor oligonucleotide
  misc_feature (34)..(36): n is a, c, g, or t
tgcaggaccagagaattcgaatacattcaaaacnnntgcatcaggt

SEQ ID NO: 6718 - DNA, 46 bp, Artificial Sequence
  Synthesized adaptor oligonucleotide
  misc_feature (34)..(36): n is a, c, g, or t
tgcaggaccagagaattcgaatacacagcccagnnntgcatcaggt

SEQ ID NO: 6719 - DNA, 46 bp, Artificial Sequence
  Synthesized adaptor oligonucleotide
  misc_feature (34)..(36): n is a, c, g, or t
tgcaggaccagagaattcgaatacagacagtagnnntgcatcaggt

SEQ ID NO: 6720 - DNA, 46 bp, Artificial Sequence
  Synthesized adaptor oligonucleotide
  misc_feature (34)..(36): n is a, c, g, or t
tgcaggaccagagaattcgaatacacatttgttnnntgcatcaggt

SEQ ID NO: 6721 - DNA, 46 bp, Artificial Sequence
  Synthesized adaptor oligonucleotide
  misc_feature (34)..(36): n is a, c, g, or t
tgcaggaccagagaattcgaatacataatccaannntgcatcaggt

SEQ ID NO: 6722 - DNA, 46 bp, Artificial Sequence
  Synthesized adaptor oligonucleotide
  misc_feature (34)..(36): n is a, c, g, or t
tgcaggaccagagaattcgaatacacgtacaacnnntgcatcaggt

SEQ ID NO: 6723 - DNA, 46 bp, Artificial Sequence
  Synthesized adaptor oligonucleotide
  misc_feature (34)..(36): n is a, c, g, or t
tgcaggaccagagaattcgaatacaatattcgannntgcatcaggt

SEQ ID NO: 6724 - DNA, 46 bp, Artificial Sequence
  Synthesized adaptor oligonucleotide
  misc_feature (34)..(36): n is a, c, g, or t
tgcaggaccagagaattcgaatacataattatannntgcatcaggt

SEQ ID NO: 6725 - DNA, 46 bp, Artificial Sequence
  Synthesized adaptor oligonucleotide
  misc_feature (34)..(36): n is a, c, g, or t
tgcaggaccagagaattcgaatacagatgcagannntgcatcaggt

SEQ ID NO: 6726 - DNA, 46 bp, Artificial Sequence
  Synthesized adaptor oligonucleotide
  misc_feature (34)..(36): n is a, c, g, or t
tgcaggaccagagaattcgaatacaggagccagnnntgcatcaggt

SEQ ID NO: 6727 - DNA, 46 bp, Artificial Sequence
  Synthesized adaptor oligonucleotide
  misc_feature (34)..(36): n is a, c, g, or t
tgcaggaccagagaattcgaatacagcgagtttnnntgcatcaggt

SEQ ID NO: 6728 - DNA, 46 bp, Artificial Sequence
  Synthesized adaptor oligonucleotide
  misc_feature (34)..(36): n is a, c, g, or t
tgcaggaccagagaattcgaatacaaagtgacgnnntgcatcaggt

SEQ ID NO: 6729 - DNA, 46 bp, Artificial Sequence
  Synthesized adaptor oligonucleotide
  misc_feature (34)..(36): n is a, c, g, or t
tgcaggaccagagaattcgaatacagctgaccgnnnacgtatgcca

SEQ ID NO: 6730 - DNA, 46 bp, Artificial Sequence
  Synthesized adaptor oligonucleotide
  misc_feature (34)..(36): n is a, c, g, or t
tgcaggaccagagaattcgaatacaccagcatannnacgtatgcca

SEQ ID NO: 6731 - DNA, 46 bp, Artificial Sequence
  Synthesized adaptor oligonucleotide
  misc_feature (34)..(36): n is a, c, g, or t
tgcaggaccagagaattcgaatacacgaaggatnnnacgtatgcca

SEQ ID NO: 6732 - DNA, 46 bp, Artificial Sequence
  Synthesized adaptor oligonucleotide
  misc_feature (34)..(36): n is a, c, g, or t
tgcaggaccagagaattcgaatacacgacgaggnnnacgtatgcca

SEQ ID NO: 6733 - DNA, 46 bp, Artificial Sequence
  Synthesized adaptor oligonucleotide
  misc_feature (34)..(36): n is a, c, g, or t
tgcaggaccagagaattcgaatacatataaccannnacgtatgcca

SEQ ID NO: 6734 - DNA, 46 bp, Artificial Sequence
  Synthesized adaptor oligonucleotide
  misc_feature (34)..(36): n is a, c, g, or t
tgcaggaccagagaattcgaatacagtggtttgnnnacgtatgcca

SEQ ID NO: 6735 - DNA, 46 bp, Artificial Sequence
  Synthesized adaptor oligonucleotide
  misc_feature (34)..(36): n is a, c, g, or t
tgcaggaccagagaattcgaatacagttgcgatnnnacgtatgcca

SEQ ID NO: 6736 - DNA, 46 bp, Artificial Sequence
  Synthesized adaptor oligonucleotide
  misc_feature (34)..(36): n is a, c, g, or t
tgcaggaccagagaattcgaatacaataccctcnnnacgtatgcca

SEQ ID NO: 6737 - DNA, 46 bp, Artificial Sequence
  Synthesized adaptor oligonucleotide
  misc_feature (34)..(36): n is a, c, g, or t
tgcaggaccagagaattcgaatacactcgaagtnnnacgtatgcca

SEQ ID NO: 6738 - DNA, 46 bp, Artificial Sequence
  Synthesized adaptor oligonucleotide
  misc_feature (34)..(36): n is a, c, g, or t
tgcaggaccagagaattcgaatacacaggccgtnnnacgtatgcca

SEQ ID NO: 6739 - DNA, 46 bp, Artificial Sequence
  Synthesized adaptor oligonucleotide
  misc_feature (34)..(36): n is a, c, g, or t
tgcaggaccagagaattcgaatacaatagtcatnnnacgtatgcca

SEQ ID NO: 6740 - DNA, 46 bp, Artificial Sequence
  Synthesized adaptor oligonucleotide
  misc_feature (34)..(36): n is a, c, g, or t
tgcaggaccagagaattcgaatacactccgtcgnnnacgtatgcca

SEQ ID NO: 6741 - DNA, 46 bp, Artificial Sequence
  Synthesized adaptor oligonucleotide
  misc_feature (34)..(36): n is a, c, g, or t
tgcaggaccagagaattcgaatacagtgccgtgnnnacgtatgcca

SEQ ID NO: 6742 - DNA, 46 bp, Artificial Sequence
  Synthesized adaptor oligonucleotide
  misc_feature (34)..(36): n is a, c, g, or t
tgcaggaccagagaattcgaatacaagtaaagtnnnacgtatgcca

SEQ ID NO: 6743 - DNA, 46 bp, Artificial Sequence
  Synthesized adaptor oligonucleotide
  misc_feature (34)..(36): n is a, c, g, or t
tgcaggaccagagaattcgaatacatattgcaannnacgtatgcca

SEQ ID NO: 6744 - DNA, 46 bp, Artificial Sequence
  Synthesized adaptor oligonucleotide
  misc_feature (34)..(36): n is a, c, g, or t
tgcaggaccagagaattcgaatacaacccagcgnnnacgtatgcca

SEQ ID NO: 6745 - DNA, 46 bp, Artificial Sequence
  Synthesized adaptor oligonucleotide
  misc_feature (34)..(36): n is a, c, g, or t
tgcaggaccagagaattcgaatacatgtcaaatnnnacgtatgcca

SEQ ID NO: 6746 - DNA, 46 bp, Artificial Sequence
  Synthesized adaptor oligonucleotide
  misc_feature (34)..(36): n is a, c, g, or t
tgcaggaccagagaattcgaatacagtgaaacgnnnacgtatgcca

SEQ ID NO: 6747 - DNA, 46 bp, Artificial Sequence
  Synthesized adaptor oligonucleotide
  misc_feature (34)..(36): n is a, c, g, or t
tgcaggaccagagaattcgaatacaagcggatannnacgtatgcca

SEQ ID NO: 6748 - DNA, 46 bp, Artificial Sequence
  Synthesized adaptor oligonucleotide
  misc_feature (34)..(36): n is a, c, g, or t
tgcaggaccagagaattcgaatacaacgcagttnnnacgtatgcca

SEQ ID NO: 6749 - DNA, 46 bp, Artificial Sequence
  Synthesized adaptor oligonucleotide
  misc_feature (34)..(36): n is a, c, g, or t
tgcaggaccagagaattcgaatacataaggatannnacgtatgcca

SEQ ID NO: 6750 - DNA, 46 bp, Artificial Sequence
  Synthesized adaptor oligonucleotide
  misc_feature (34)..(36): n is a, c, g, or t
tgcaggaccagagaattcgaatacatagtggagnnnacgtatgcca

SEQ ID NO: 6751 - DNA, 46 bp, Artificial Sequence
  Synthesized adaptor oligonucleotide
  misc_feature (34)..(36): n is a, c, g, or t
tgcaggaccagagaattcgaatacatgtggaagnnnacgtatgcca

SEQ ID NO: 6752 - DNA, 46 bp, Artificial Sequence
  Synthesized adaptor oligonucleotide
  misc_feature (34)..(36): n is a, c, g, or t
tgcaggaccagagaattcgaatacacccacgtcnnnacgtatgcca

SEQ ID NO: 6753 - DNA, 46 bp, Artificial Sequence
  Synthesized adaptor oligonucleotide
  misc_feature (34)..(36): n is a, c, g, or t
tgcaggaccagagaattcgaatacagtaacggannnacgtatgcca

SEQ ID NO: 6754 - DNA, 46 bp, Artificial Sequence
  Synthesized adaptor oligonucleotide
  misc_feature (34)..(36): n is a, c, g, or t
tgcaggaccagagaattcgaatacattctacatnnnacgtatgcca

SEQ ID NO: 6755 - DNA, 46 bp, Artificial Sequence
  Synthesized adaptor oligonucleotide
  misc_feature (34)..(36): n is a, c, g, or t
tgcaggaccagagaattcgaatacatcaatgatnnnacgtatgcca

SEQ ID NO: 6756 - DNA, 46 bp, Artificial Sequence
  Synthesized adaptor oligonucleotide
  misc_feature (34)..(36): n is a, c, g, or t
tgcaggaccagagaattcgaatacatcgcgaatnnnacgtatgcca

SEQ ID NO: 6757 - DNA, 46 bp, Artificial Sequence
  Synthesized adaptor oligonucleotide
  misc_feature (34)..(36): n is a, c, g, or t
tgcaggaccagagaattcgaatacataatgactnnnacgtatgcca

SEQ ID NO: 6758 - DNA, 46 bp, Artificial Sequence
  Synthesized adaptor oligonucleotide
  misc_feature (34)..(36): n is a, c, g, or t
tgcaggaccagagaattcgaatacacaggtttgnnnacgtatgcca

SEQ ID NO: 6759 - DNA, 46 bp, Artificial Sequence
  Synthesized adaptor oligonucleotide
  misc_feature (34)..(36): n is a, c, g, or t
tgcaggaccagagaattcgaatacattcggcttnnnacgtatgcca

SEQ ID NO: 6760 - DNA, 46 bp, Artificial Sequence
  Synthesized adaptor oligonucleotide
  misc_feature (34)..(36): n is a, c, g, or t
tgcaggaccagagaattcgaatacaccttattannnacgtatgcca

SEQ ID NO: 6761 - DNA, 46 bp, Artificial Sequence
  Synthesized adaptor oligonucleotide
  misc_feature (34)..(36): n is a, c, g, or t
tgcaggaccagagaattcgaatacatagcatgcnnnacgtatgcca

SEQ ID NO: 6762 - DNA, 46 bp, Artificial Sequence
  Synthesized adaptor oligonucleotide
  misc_feature (34)..(36): n is a, c, g, or t
tgcaggaccagagaattcgaatacaaaaacgcgnnnacgtatgcca

SEQ ID NO: 6763 - DNA, 46 bp, Artificial Sequence
  Synthesized adaptor oligonucleotide
  misc_feature (34)..(36): n is a, c, g, or t
tgcaggaccagagaattcgaatacatagctgacnnnacgtatgcca

SEQ ID NO: 6764 - DNA, 46 bp, Artificial Sequence
  Synthesized adaptor oligonucleotide
  misc_feature (34)..(36): n is a, c, g, or t
tgcaggaccagagaattcgaatacactaccccgnnnacgtatgcca

SEQ ID NO: 6765 - DNA, 46 bp, Artificial Sequence
  Synthesized adaptor oligonucleotide
  misc_feature (34)..(36): n is a, c, g, or t
tgcaggaccagagaattcgaatacaagctgtcannnacgtatgcca

SEQ ID NO: 6766 - DNA, 46 bp, Artificial Sequence
  Synthesized adaptor oligonucleotide
  misc_feature (34)..(36): n is a, c, g, or t
tgcaggaccagagaattcgaatacaccctcagcnnnacgtatgcca

SEQ ID NO: 6767 - DNA, 46 bp, Artificial Sequence
  Synthesized adaptor oligonucleotide
  misc_feature (34)..(36): n is a, c, g, or t
tgcaggaccagagaattcgaatacacacgttctnnnacgtatgcca

SEQ ID NO: 6768 - DNA, 46 bp, Artificial Sequence
  Synthesized adaptor oligonucleotide
  misc_feature (34)..(36): n is a, c, g, or t
tgcaggaccagagaattcgaatacaacggaacannnacgtatgcca

SEQ ID NO: 6769 - DNA, 46 bp, Artificial Sequence
  Synthesized adaptor oligonucleotide
  misc_feature (34)..(36): n is a, c, g, or t
tgcaggaccagagaattcgaatacagatcattannnacgtatgcca

SEQ ID NO: 6770 - DNA, 46 bp, Artificial Sequence
  Synthesized adaptor oligonucleotide
  misc_feature (34)..(36): n is a, c, g, or t
tgcaggaccagagaattcgaatacactagaaccnnnacgtatgcca

SEQ ID NO: 6771 - DNA, 46 bp, Artificial Sequence
  Synthesized adaptor oligonucleotide
  misc_feature (34)..(36): n is a, c, g, or t
tgcaggaccagagaattcgaatacatttaggtannnacgtatgcca

SEQ ID NO: 6772 - DNA, 46 bp, Artificial Sequence
  Synthesized adaptor oligonucleotide
  misc_feature (34)..(36): n is a, c, g, or t
tgcaggaccagagaattcgaatacatgatattgnnnacgtatgcca

SEQ ID NO: 6773 - DNA, 46 bp, Artificial Sequence
  Synthesized adaptor oligonucleotide
  misc_feature (34)..(36): n is a, c, g, or t
tgcaggaccagagaattcgaatacagcgaaaacnnnacgtatgcca

SEQ ID NO: 6774 - DNA, 46 bp, Artificial Sequence
  Synthesized adaptor oligonucleotide
  misc_feature (34)..(36): n is a, c, g, or t
tgcaggaccagagaattcgaatacaactaacgcnnnacgtatgcca

SEQ ID NO: 6775 - DNA, 46 bp, Artificial Sequence
  Synthesized adaptor oligonucleotide
  misc_feature (34)..(36): n is a, c, g, or t
tgcaggaccagagaattcgaatacatacttgccnnnacgtatgcca

SEQ ID NO: 6776 - DNA, 46 bp, Artificial Sequence
  Synthesized adaptor oligonucleotide
  misc_feature (34)..(36): n is a, c, g, or t
tgcaggaccagagaattcgaatacacgtgctaannnacgtatgcca

SEQ ID NO: 6777 - DNA, 46 bp, Artificial Sequence
  Synthesized adaptor oligonucleotide
  misc_feature (34)..(36): n is a, c, g, or t
tgcaggaccagagaattcgaatacaaaacagtannnacgtatgcca

SEQ ID NO: 6778 - DNA, 46 bp, Artificial Sequence
  Synthesized adaptor oligonucleotide
  misc_feature (34)..(36): n is a, c, g, or t
tgcaggaccagagaattcgaatacagcatcatgnnnacgtatgcca

SEQ ID NO: 6779 - DNA, 46 bp, Artificial Sequence
  Synthesized adaptor oligonucleotide
  misc_feature (34)..(36): n is a, c, g, or t
tgcaggaccagagaattcgaatacaacctcgaannnacgtatgcca

SEQ ID NO: 6780 - DNA, 46 bp, Artificial Sequence
  Synthesized adaptor oligonucleotide
  misc_feature (34)..(36): n is a, c, g, or t
tgcaggaccagagaattcgaatacaacagctacnnnacgtatgcca

SEQ ID NO: 6781 - DNA, 46 bp, Artificial Sequence
  Synthesized adaptor oligonucleotide
  misc_feature (34)..(36): n is a, c, g, or t
tgcaggaccagagaattcgaatacacgtcaacannnacgtatgcca

SEQ ID NO: 6782 - DNA, 46 bp, Artificial Sequence
  Synthesized adaptor oligonucleotide
  misc_feature (34)..(36): n is a, c, g, or t
tgcaggaccagagaattcgaatacaccggccccnnnacgtatgcca

SEQ ID NO: 6783 - DNA, 46 bp, Artificial Sequence
  Synthesized adaptor oligonucleotide
  misc_feature (34)..(36): n is a, c, g, or t
tgcaggaccagagaattcgaatacatcgcgtggnnnacgtatgcca

SEQ ID NO: 6784 - DNA, 46 bp, Artificial Sequence
  Synthesized adaptor oligonucleotide
  misc_feature (34)..(36): n is a, c, g, or t
tgcaggaccagagaattcgaatacaaagactggnnnacgtatgcca

SEQ ID NO: 6785 - DNA, 46 bp, Artificial Sequence
  Synthesized adaptor oligonucleotide
  misc_feature (34)..(36): n is a, c, g, or t
tgcaggaccagagaattcgaatacagcaatgagnnnacgtatgcca

SEQ ID NO: 6786 - DNA, 46 bp, Artificial Sequence
  Synthesized adaptor oligonucleotide
  misc_feature (34)..(36): n is a, c, g, or t
tgcaggaccagagaattcgaatacaaggagctannnacgtatgcca

SEQ ID NO: 6787 - DNA, 46 bp, Artificial Sequence
  Synthesized adaptor oligonucleotide
  misc_feature (34)..(36): n is a, c, g, or t
tgcaggaccagagaattcgaatacacctgagatnnnacgtatgcca

SEQ ID NO: 6788 - DNA, 46 bp, Artificial Sequence
  Synthesized adaptor oligonucleotide
  misc_feature (34)..(36): n is a, c, g, or t
tgcaggaccagagaattcgaatacaacggaggcnnnacgtatgcca

SEQ ID NO: 6789 - DNA, 46 bp, Artificial Sequence
  Synthesized adaptor oligonucleotide
  misc_feature (34)..(36): n is a, c, g, or t
tgcaggaccagagaattcgaatacagatcggccnnnctagcgttac

SEQ ID NO: 6790 - DNA, 46 bp, Artificial Sequence
  Synthesized adaptor oligonucleotide
  misc_feature (34)..(36): n is a, c, g, or t
tgcaggaccagagaattcgaatacatgctgcaannnctagcgttac

SEQ ID NO: 6791 - DNA, 46 bp, Artificial Sequence
  Synthesized adaptor oligonucleotide
  misc_feature (34)..(36): n is a, c, g, or t
tgcaggaccagagaattcgaatacatcggaatcnnnctagcgttac

SEQ ID NO: 6792 - DNA, 46 bp, Artificial Sequence
  Synthesized adaptor oligonucleotide
  misc_feature (34)..(36): n is a, c, g, or t
tgcaggaccagagaattcgaatacagacggctcnnnctagcgttac

SEQ ID NO: 6793 - DNA, 46 bp, Artificial Sequence
  Synthesized adaptor oligonucleotide
  misc_feature (34)..(36): n is a, c, g, or t
tgcaggaccagagaattcgaatacaagttggagnnnctagcgttac

SEQ ID NO: 6794 - DNA, 46 bp, Artificial Sequence
  Synthesized adaptor oligonucleotide
  misc_feature (34)..(36): n is a, c, g, or t
tgcaggaccagagaattcgaatacaagtacgtcnnnctagcgttac

SEQ ID NO: 6795 - DNA, 46 bp, Artificial Sequence
  Synthesized adaptor oligonucleotide
  misc_feature (34)..(36): n is a, c, g, or t
tgcaggaccagagaattcgaatacacgattaatnnnctagcgttac

SEQ ID NO: 6796 - DNA, 46 bp, Artificial Sequence
  Synthesized adaptor oligonucleotide
  misc_feature (34)..(36): n is a, c, g, or t
tgcaggaccagagaattcgaatacattacgcctnnnctagcgttac

SEQ ID NO: 6797 - DNA, 46 bp, Artificial Sequence
  Synthesized adaptor oligonucleotide
  misc_feature (34)..(36): n is a, c, g, or t
tgcaggaccagagaattcgaatacaaggagttgnnnctagcgttac

SEQ ID NO: 6798 - DNA, 46 bp, Artificial Sequence
  Synthesized adaptor oligonucleotide
  misc_feature (34)..(36): n is a, c, g, or t
tgcaggaccagagaattcgaatacagtacaccannnctagcgttac

SEQ ID NO: 6799 - DNA, 46 bp, Artificial Sequence
  Synthesized adaptor oligonucleotide
  misc_feature (34)..(36): n is a, c, g, or t
tgcaggaccagagaattcgaatacaggaaaattnnnctagcgttac

SEQ ID NO: 6800 - DNA, 46 bp, Artificial Sequence
  Synthesized adaptor oligonucleotide
  misc_feature (34)..(36): n is a, c, g, or t
tgcaggaccagagaattcgaatacacggttcttnnnctagcgttac

SEQ ID NO: 6801 - DNA, 46 bp, Artificial Sequence
  Synthesized adaptor oligonucleotide
  misc_feature (34)..(36): n is a, c, g, or t
tgcaggaccagagaattcgaatacaggtcgaccnnnctagcgttac

SEQ ID NO: 6802 - DNA, 46 bp, Artificial Sequence
  Synthesized adaptor oligonucleotide
  misc_feature (34)..(36): n is a, c, g, or t
tgcaggaccagagaattcgaatacattcgctcannnctagcgttac

SEQ ID NO: 6803 - DNA, 46 bp, Artificial Sequence
  Synthesized adaptor oligonucleotide
  misc_feature (34)..(36): n is a, c, g, or t
tgcaggaccagagaattcgaatacacgcagcgtnnnctagcgttac

SEQ ID NO: 6804 - DNA, 46 bp, Artificial Sequence
  Synthesized adaptor oligonucleotide
  misc_feature (34)..(36): n is a, c, g, or t
tgcaggaccagagaattcgaatacagctgtgcgnnnctagcgttac

SEQ ID NO: 6805 - DNA, 46 bp, Artificial Sequence
  Synthesized adaptor oligonucleotide
  misc_feature (34)..(36): n is a, c, g, or t
tgcaggaccagagaattcgaatacacaccagtannnctagcgttac

SEQ ID NO: 6806 - DNA, 46 bp, Artificial Sequence
  Synthesized adaptor oligonucleotide
  misc_feature (34)..(36): n is a, c, g, or t
tgcaggaccagagaattcgaatacaatcattgannnctagcgttac

SEQ ID NO: 6807 - DNA, 46 bp, Artificial Sequence
  Synthesized adaptor oligonucleotide
  misc_feature (34)..(36): n is a, c, g, or t
tgcaggaccagagaattcgaatacataatcatgnnnctagcgttac

SEQ ID NO: 6808 - DNA, 46 bp, Artificial Sequence
  Synthesized adaptor oligonucleotide
  misc_feature (34)..(36): n is a, c, g, or t
tgcaggaccagagaattcgaatacagttgaccannnctagcgttac

SEQ ID NO: 6809 - DNA, 46 bp, Artificial Sequence
  Synthesized adaptor oligonucleotide
  misc_feature (34)..(36): n is a, c, g, or t
tgcaggaccagagaattcgaatacaactcatggnnnctagcgttac

SEQ ID NO: 6810 - DNA, 46 bp, Artificial Sequence
  Synthesized adaptor oligonucleotide
  misc_feature (34)..(36): n is a, c, g, or t
tgcaggaccagagaattcgaatacacccagtttnnnctagcgttac

SEQ ID NO: 6811 - DNA, 46 bp, Artificial Sequence
  Synthesized adaptor oligonucleotide
  misc_feature (34)..(36): n is a, c, g, or t
tgcaggaccagagaattcgaatacatcaaggagnnnctagcgttac

SEQ ID NO: 6812 - DNA, 46 bp, Artificial Sequence
  Synthesized adaptor oligonucleotide
  misc_feature (34)..(36): n is a, c, g, or t
tgcaggaccagagaattcgaatacaaacgcttgnnnctagcgttac

SEQ ID NO: 6813 - DNA, 46 bp, Artificial Sequence
  Synthesized adaptor oligonucleotide
  misc_feature (34)..(36): n is a, c, g, or t
tgcaggaccagagaattcgaatacacttatatcnnnctagcgttac

SEQ ID NO: 6814 - DNA, 46 bp, Artificial Sequence
  Synthesized adaptor oligonucleotide
  misc_feature (34)..(36): n is a, c, g, or t
tgcaggaccagagaattcgaatacaagtgtccannnctagcgttac

SEQ ID NO: 6815 - DNA, 46 bp, Artificial Sequence
  Synthesized adaptor oligonucleotide
  misc_feature (34)..(36): n is a, c, g, or t
tgcaggaccagagaattcgaatacaagcgacggnnnctagcgttac

SEQ ID NO: 6816 - DNA, 46 bp, Artificial Sequence
  Synthesized adaptor oligonucleotide
  misc_feature (34)..(36): n is a, c, g, or t
tgcaggaccagagaattcgaatacactgtcccgnnnctagcgttac

SEQ ID NO: 6817 - DNA, 46 bp, Artificial Sequence
  Synthesized adaptor oligonucleotide
  misc_feature (34)..(36): n is a, c, g, or t
tgcaggaccagagaattcgaatacaactcacctnnnctagcgttac

SEQ ID NO: 6818 - DNA, 46 bp, Artificial Sequence
  Synthesized adaptor oligonucleotide
  misc_feature (34)..(36): n is a, c, g, or t
tgcaggaccagagaattcgaatacaaatttcgannnctagcgttac

SEQ ID NO: 6819 - DNA, 46 bp, Artificial Sequence
  Synthesized adaptor oligonucleotide
  misc_feature (34)..(36): n is a, c, g, or t
tgcaggaccagagaattcgaatacagtaatatcnnnctagcgttac

SEQ ID NO: 6820 - DNA, 46 bp, Artificial Sequence
  Synthesized adaptor oligonucleotide
  misc_feature (34)..(36): n is a, c, g, or t
tgcaggaccagagaattcgaatacacaagaaatnnnctagcgttac

SEQ ID NO: 6821 - DNA, 46 bp, Artificial Sequence
  Synthesized adaptor oligonucleotide
  misc_feature (34)..(36): n is a, c, g, or t
tgcaggaccagagaattcgaatacaattccccannnctagcgttac

SEQ ID NO: 6822 - DNA, 46 bp, Artificial Sequence
  Synthesized adaptor oligonucleotide
  misc_feature (34)..(36): n is a, c, g, or t
tgcaggaccagagaattcgaatacactcttagcnnnctagcgttac

SEQ ID NO: 6823 - DNA, 46 bp, Artificial Sequence
  Synthesized adaptor oligonucleotide
  misc_feature (34)..(36): n is a, c, g, or t
tgcaggaccagagaattcgaatacataccagcannnctagcgttac

SEQ ID NO: 6824 - DNA, 46 bp, Artificial Sequence
  Synthesized adaptor oligonucleotide
  misc_feature (34)..(36): n is a, c, g, or t
tgcaggaccagagaattcgaatacacacgcctcnnnctagcgttac

SEQ ID NO: 6825 - DNA, 46 bp, Artificial Sequence
  Synthesized adaptor oligonucleotide
  misc_feature (34)..(36): n is a, c, g, or t
tgcaggaccagagaattcgaatacaaatcgaggnnnctagcgttac

SEQ ID NO: 6826 - DNA, 46 bp, Artificial Sequence
  Synthesized adaptor oligonucleotide
  misc_feature (34)..(36): n is a, c, g, or t
tgcaggaccagagaattcgaatacacatacaatnnnctagcgttac

SEQ ID NO: 6827 - DNA, 46 bp, Artificial Sequence
  Synthesized adaptor oligonucleotide
  misc_feature (34)..(36): n is a, c, g, or t
tgcaggaccagagaattcgaatacattatgttcnnnctagcgttac

SEQ ID NO: 6828 - DNA, 46 bp, Artificial Sequence
  Synthesized adaptor oligonucleotide
  misc_feature (34)..(36): n is a, c, g, or t
tgcaggaccagagaattcgaatacagtctgtctnnnctagcgttac

SEQ ID NO: 6829 - DNA, 46 bp, Artificial Sequence
  Synthesized adaptor oligonucleotide
  misc_feature (34)..(36): n is a, c, g, or t
tgcaggaccagagaattcgaatacagtctgaacnnnctagcgttac

SEQ ID NO: 6830 - DNA, 46 bp, Artificial Sequence
  Synthesized adaptor oligonucleotide
  misc_feature (34)..(36): n is a, c, g, or t
tgcaggaccagagaattcgaatacaaggtgcggnnnctagcgttac

SEQ ID NO: 6831 - DNA, 46 bp, Artificial Sequence
  Synthesized adaptor oligonucleotide
  misc_feature (34)..(36): n is a, c, g, or t
tgcaggaccagagaattcgaatacacagaaacgnnnctagcgttac

SEQ ID NO: 6832 - DNA, 46 bp, Artificial Sequence
  Synthesized adaptor oligonucleotide
  misc_feature (34)..(36): n is a, c, g, or t
tgcaggaccagagaattcgaatacatctgttgcnnnctagcgttac

SEQ ID NO: 6833 - DNA, 46 bp, Artificial Sequence
  Synthesized adaptor oligonucleotide
  misc_feature (34)..(36): n is a, c, g, or t
tgcaggaccagagaattcgaatacacgatggttnnnctagcgttac

SEQ ID NO: 6834 - DNA, 46 bp, Artificial Sequence
  Synthesized adaptor oligonucleotide
  misc_feature (34)..(36): n is a, c, g, or t
tgcaggaccagagaattcgaatacaataatattnnnctagcgttac

SEQ ID NO: 6835 - DNA, 46 bp, Artificial Sequence
  Synthesized adaptor oligonucleotide
  misc_feature (34)..(36): n is a, c, g, or t
tgcaggaccagagaattcgaatacaatcgacgtnnnctagcgttac

SEQ ID NO: 6836 - DNA, 46 bp, Artificial Sequence
  Synthesized adaptor oligonucleotide
  misc_feature (34)..(36): n is a, c, g, or t
tgcaggaccagagaattcgaatacagaggaaagnnnctagcgttac

SEQ ID NO: 6837 - DNA, 46 bp, Artificial Sequence
  Synthesized adaptor oligonucleotide
  misc_feature (34)..(36): n is a, c, g, or t
tgcaggaccagagaattcgaatacaattacacannnctagcgttac

SEQ ID NO: 6838 - DNA, 46 bp, Artificial Sequence
  Synthesized adaptor oligonucleotide
  misc_feature (34)..(36): n is a, c, g, or t
tgcaggaccagagaattcgaatacaggacctgcnnnctagcgttac

SEQ ID NO: 6839 - DNA, 46 bp, Artificial Sequence
  Synthesized adaptor oligonucleotide
  misc_feature (34)..(36): n is a, c, g, or t
tgcaggaccagagaattcgaatacaacgtagagnnnctagcgttac

SEQ ID NO: 6840 - DNA, 46 bp, Artificial Sequence
  Synthesized adaptor oligonucleotide
  misc_feature (34)..(36): n is a, c, g, or t
tgcaggaccagagaattcgaatacacacggcgtnnnctagcgttac

SEQ ID NO: 6841 - DNA, 46 bp, Artificial Sequence
  Synthesized adaptor oligonucleotide
  misc_feature (34)..(36): n is a, c, g, or t
tgcaggaccagagaattcgaatacaattacgtannnctagcgttac

SEQ ID NO: 6842 - DNA, 46 bp, Artificial Sequence
  Synthesized adaptor oligonucleotide
  misc_feature (34)..(36): n is a, c, g, or t
tgcaggaccagagaattcgaatacatatgttgannnctagcgttac

SEQ ID NO: 6843 - DNA, 46 bp, Artificial Sequence
  Synthesized adaptor oligonucleotide
  misc_feature (34)..(36): n is a, c, g, or t
tgcaggaccagagaattcgaatacacagactcannnctagcgttac

SEQ ID NO: 6844 - DNA, 46 bp, Artificial Sequence
  Synthesized adaptor oligonucleotide
  misc_feature (34)..(36): n is a, c, g, or t
tgcaggaccagagaattcgaatacacggatgccnnnctagcgttac

SEQ ID NO: 6845 - DNA, 46 bp, Artificial Sequence
  Synthesized adaptor oligonucleotide
  misc_feature (34)..(36): n is a, c, g, or t
tgcaggaccagagaattcgaatacatacatcttnnnctagcgttac

SEQ ID NO: 6846 - DNA, 46 bp, Artificial Sequence
  Synthesized adaptor oligonucleotide
  misc_feature (34)..(36): n is a, c, g, or t
tgcaggaccagagaattcgaatacacttcgtgtnnnctagcgttac

SEQ ID NO: 6847 - DNA, 46 bp, Artificial Sequence
  Synthesized adaptor oligonucleotide
  misc_feature (34)..(36): n is a, c, g, or t
tgcaggaccagagaattcgaatacagaacgcggnnnctagcgttac

SEQ ID NO: 6848 - DNA, 46 bp, Artificial Sequence
  Synthesized adaptor oligonucleotide
  misc_feature (34)..(36): n is a, c, g, or t
tgcaggaccagagaattcgaatacatcggattgnnnctagcgttac

SEQ ID NO: 6849 - DNA, 46 bp, Artificial Sequence
  Synthesized adaptor oligonucleotide
  misc_feature (34)..(36): n is a, c, g, or t
tgcaggaccagagaattcgaatacaagacaaatnnngatcgacatg

SEQ ID NO: 6850 - DNA, 46 bp, Artificial Sequence
  Synthesized adaptor oligonucleotide
  misc_feature (34)..(36): n is a, c, g, or t
tgcaggaccagagaattcgaatacacgaagtagnnngatcgacatg

SEQ ID NO: 6851 - DNA, 46 bp, Artificial Sequence
  Synthesized adaptor oligonucleotide
  misc_feature (34)..(36): n is a, c, g, or t
tgcaggaccagagaattcgaatacaaaagagccnnngatcgacatg

SEQ ID NO: 6852 - DNA, 46 bp, Artificial Sequence
  Synthesized adaptor oligonucleotide
  misc_feature (34)..(36): n is a, c, g, or t
tgcaggaccagagaattcgaatacatgagtggannngatcgacatg

SEQ ID NO: 6853 - DNA, 46 bp, Artificial Sequence
  Synthesized adaptor oligonucleotide
  misc_feature (34)..(36): n is a, c, g, or t
tgcaggaccagagaattcgaatacacgctcccannngatcgacatg

SEQ ID NO: 6854 - DNA, 46 bp, Artificial Sequence
  Synthesized adaptor oligonucleotide
  misc_feature (34)..(36): n is a, c, g, or t
tgcaggaccagagaattcgaatacaacacttccnnngatcgacatg

SEQ ID NO: 6855 - DNA, 46 bp, Artificial Sequence
  Synthesized adaptor oligonucleotide
  misc_feature (34)..(36): n is a, c, g, or t
tgcaggaccagagaattcgaatacagcagtcatnnngatcgacatg

SEQ ID NO: 6856 - DNA, 46 bp, Artificial Sequence
  Synthesized adaptor oligonucleotide
  misc_feature (34)..(36): n is a, c, g, or t
tgcaggaccagagaattcgaatacaccatatggnnngatcgacatg

SEQ ID NO: 6857 - DNA, 46 bp, Artificial Sequence
  Synthesized adaptor oligonucleotide
  misc_feature (34)..(36): n is a, c, g, or t
tgcaggaccagagaattcgaatacaatgcgccgnnngatcgacatg

SEQ ID NO: 6858 - DNA, 46 bp, Artificial Sequence
  Synthesized adaptor oligonucleotide
  misc_feature (34)..(36): n is a, c, g, or t
tgcaggaccagagaattcgaatacagttgaaccnnngatcgacatg

SEQ ID NO: 6859 - DNA, 46 bp, Artificial Sequence
  Synthesized adaptor oligonucleotide
  misc_feature (34)..(36): n is a, c, g, or t
tgcaggaccagagaattcgaatacaaaggttggnnngatcgacatg

SEQ ID NO: 6860 - DNA, 46 bp, Artificial Sequence
  Synthesized adaptor oligonucleotide
  misc_feature (34)..(36): n is a, c, g, or t
tgcaggaccagagaattcgaatacagcacgctgnnngatcgacatg

SEQ ID NO: 6861 - DNA, 46 bp, Artificial Sequence
  Synthesized adaptor oligonucleotide
  misc_feature (34)..(36): n is a, c, g, or t
tgcaggaccagagaattcgaatacagctcatagnnngatcgacatg

SEQ ID NO: 6862 - DNA, 46 bp, Artificial Sequence
  Synthesized adaptor oligonucleotide
  misc_feature (34)..(36): n is a, c, g, or t
tgcaggaccagagaattcgaatacaacagtctgnnngatcgacatg

SEQ ID NO: 6863 - DNA, 46 bp, Artificial Sequence
  Synthesized adaptor oligonucleotide
  misc_feature (34)..(36): n is a, c, g, or t
tgcaggaccagagaattcgaatacatttaagtgnnngatcgacatg

SEQ ID NO: 6864 - DNA, 46 bp, Artificial Sequence
  Synthesized adaptor oligonucleotide
  misc_feature (34)..(36): n is a, c, g, or t
tgcaggaccagagaattcgaatacagattaatcnnngatcgacatg

SEQ ID NO: 6865 - DNA, 46 bp, Artificial Sequence
  Synthesized adaptor oligonucleotide
  misc_feature (34)..(36): n is a, c, g, or t
tgcaggaccagagaattcgaatacagagaaaggnnngatcgacatg

SEQ ID NO: 6866 - DNA, 46 bp, Artificial Sequence
  Synthesized adaptor oligonucleotide
  misc_feature (34)..(36): n is a, c, g, or t
tgcaggaccagagaattcgaatacaacattcggnnngatcgacatg

SEQ ID NO: 6867 - DNA, 46 bp, Artificial Sequence
  Synthesized adaptor oligonucleotide
  misc_feature (34)..(36): n is a, c, g, or t
tgcaggaccagagaattcgaatacattgcgtctnnngatcgacatg

SEQ ID NO: 6868 - DNA, 46 bp, Artificial Sequence
  Synthesized adaptor oligonucleotide
  misc_feature (34)..(36): n is a, c, g, or t
tgcaggaccagagaattcgaatacagctcacaannngatcgacatg

SEQ ID NO: 6869 - DNA, 46 bp, Artificial Sequence
  Synthesized adaptor oligonucleotide
  misc_feature (34)..(36): n is a, c, g, or t
tgcaggaccagagaattcgaatacacgttaacgnnngatcgacatg

SEQ ID NO: 6870 - DNA, 46 bp, Artificial Sequence
  Synthesized adaptor oligonucleotide
  misc_feature (34)..(36): n is a, c, g, or t
tgcaggaccagagaattcgaatacagtacgttgnnngatcgacatg

SEQ ID NO: 6871 - DNA, 46 bp, Artificial Sequence
  Synthesized adaptor oligonucleotide
  misc_feature (34)..(36): n is a, c, g, or t
tgcaggaccagagaattcgaatacatgctcagannngatcgacatg

SEQ ID NO: 6872 - DNA, 46 bp, Artificial Sequence
  Synthesized adaptor oligonucleotide
  misc_feature (34)..(36): n is a, c, g, or t
tgcaggaccagagaattcgaatacataccaaatnnngatcgacatg

SEQ ID NO: 6873 - DNA, 46 bp, Artificial Sequence
  Synthesized adaptor oligonucleotide
  misc_feature (34)..(36): n is a, c, g, or t
tgcaggaccagagaattcgaatacaccatgatgnnngatcgacatg

SEQ ID NO: 6874 - DNA, 46 bp, Artificial Sequence
  Synthesized adaptor oligonucleotide
  misc_feature (34)..(36): n is a, c, g, or t
tgcaggaccagagaattcgaatacatatatgcannngatcgacatg

SEQ ID NO: 6875 - DNA, 46 bp, Artificial Sequence
  Synthesized adaptor oligonucleotide
  misc_feature (34)..(36): n is a, c, g, or t
tgcaggaccagagaattcgaatacaccgcttatnnngatcgacatg

SEQ ID NO: 6876 - DNA, 46 bp, Artificial Sequence
  Synthesized adaptor oligonucleotide
  misc_feature (34)..(36): n is a, c, g, or t
tgcaggaccagagaattcgaatacaggcgtcacnnngatcgacatg

SEQ ID NO: 6877 - DNA, 46 bp, Artificial Sequence
  Synthesized adaptor oligonucleotide
  misc_feature (34)..(36): n is a, c, g, or t
tgcaggaccagagaattcgaatacaggcataagnnngatcgacatg

SEQ ID NO: 6878 - DNA, 46 bp, Artificial Sequence
  Synthesized adaptor oligonucleotide
  misc_feature (34)..(36): n is a, c, g, or t
tgcaggaccagagaattcgaatacagaatttgtnnngatcgacatg

SEQ ID NO: 6879 - DNA, 46 bp, Artificial Sequence
  Synthesized adaptor oligonucleotide
  misc_feature (34)..(36): n is a, c, g, or t
tgcaggaccagagaattcgaatacatcttgaccnnngatcgacatg

SEQ ID NO: 6880 - DNA, 46 bp, Artificial Sequence
  Synthesized adaptor oligonucleotide
  misc_feature (34)..(36): n is a, c, g, or t
tgcaggaccagagaattcgaatacaacacctagnnngatcgacatg

SEQ ID NO: 6881 - DNA, 46 bp, Artificial Sequence
  Synthesized adaptor oligonucleotide
  misc_feature (34)..(36): n is a, c, g, or t
tgcaggaccagagaattcgaatacaatctcaccnnngatcgacatg

SEQ ID NO: 6882 - DNA, 46 bp, Artificial Sequence
  Synthesized adaptor oligonucleotide
  misc_feature (34)..(36): n is a, c, g, or t
tgcaggaccagagaattcgaatacattgagattnnngatcgacatg

SEQ ID NO: 6883 - DNA, 46 bp, Artificial Sequence
  Synthesized adaptor oligonucleotide
  misc_feature (34)..(36): n is a, c, g, or t
tgcaggaccagagaattcgaatacatcaaccagnnngatcgacatg

SEQ ID NO: 6884 - DNA, 46 bp, Artificial Sequence
  Synthesized adaptor oligonucleotide
  misc_feature (34)..(36): n is a, c, g, or t
tgcaggaccagagaattcgaatacatttgacggnnngatcgacatg

SEQ ID NO: 6885 - DNA, 46 bp, Artificial Sequence
  Synthesized adaptor oligonucleotide
  misc_feature (34)..(36): n is a, c, g, or t
tgcaggaccagagaattcgaatacagttcatttnnngatcgacatg

SEQ ID NO: 6886 - DNA, 46 bp, Artificial Sequence
  Synthesized adaptor oligonucleotide
  misc_feature (34)..(36): n is a, c, g, or t
tgcaggaccagagaattcgaatacagagtggtannngatcgacatg

SEQ ID NO: 6887 - DNA, 46 bp, Artificial Sequence
  Synthesized adaptor oligonucleotide
  misc_feature (34)..(36): n is a, c, g, or t
tgcaggaccagagaattcgaatacaagttgctgnnngatcgacatg

SEQ ID NO: 6888 - DNA, 46 bp, Artificial Sequence
  Synthesized adaptor oligonucleotide
  misc_feature (34)..(36): n is a, c, g, or t
tgcaggaccagagaattcgaatacagattttagnnngatcgacatg

SEQ ID NO: 6889 - DNA, 46 bp, Artificial Sequence
  Synthesized adaptor oligonucleotide
  misc_feature (34)..(36): n is a, c, g, or t
tgcaggaccagagaattcgaatacactaacaatnnngatcgacatg

SEQ ID NO: 6890 - DNA, 46 bp, Artificial Sequence
  Synthesized adaptor oligonucleotide
  misc_feature (34)..(36): n is a, c, g, or t
tgcaggaccagagaattcgaatacaagctgatcnnngatcgacatg

SEQ ID NO: 6891 - DNA, 46 bp, Artificial Sequence
  Synthesized adaptor oligonucleotide
  misc_feature (34)..(36): n is a, c, g, or t
tgcaggaccagagaattcgaatacacgacggctnnngatcgacatg

SEQ ID NO: 6892 - DNA, 46 bp, Artificial Sequence
  Synthesized adaptor oligonucleotide
  misc_feature (34)..(36): n is a, c, g, or t
tgcaggaccagagaattcgaatacacggcgtacnnngatcgacatg

SEQ ID NO: 6893 - DNA, 46 bp, Artificial Sequence
  Synthesized adaptor oligonucleotide
  misc_feature (34)..(36): n is a, c, g, or t
tgcaggaccagagaattcgaatacattgcaggtnnngatcgacatg

SEQ ID NO: 6894 - DNA, 46 bp, Artificial Sequence
  Synthesized adaptor oligonucleotide
  misc_feature (34)..(36): n is a, c, g, or t
tgcaggaccagagaattcgaatacatgagctgtnnngatcgacatg

SEQ ID NO: 6895 - DNA, 46 bp, Artificial Sequence
  Synthesized adaptor oligonucleotide
  misc_feature (34)..(36): n is a, c, g, or t
tgcaggaccagagaattcgaatacaagtctcagnnngatcgacatg

SEQ ID NO: 6896 - DNA, 46 bp, Artificial Sequence
  Synthesized adaptor oligonucleotide
  misc_feature (34)..(36): n is a, c, g, or t
tgcaggaccagagaattcgaatacaattccttannngatcgacatg

SEQ ID NO: 6897 - DNA, 46 bp, Artificial Sequence
  Synthesized adaptor oligonucleotide
  misc_feature (34)..(36): n is a, c, g, or t
tgcaggaccagagaattcgaatacagagagagannngatcgacatg

SEQ ID NO: 6898 - DNA, 46 bp, Artificial Sequence
  Synthesized adaptor oligonucleotide
  misc_feature (34)..(36): n is a, c, g, or t
tgcaggaccagagaattcgaatacagcagagcgnnngatcgacatg

SEQ ID NO: 6899 - DNA, 46 bp, Artificial Sequence
  Synthesized adaptor oligonucleotide
  misc_feature (34)..(36): n is a, c, g, or t
tgcaggaccagagaattcgaatacaggcactatnnngatcgacatg

SEQ ID NO: 6900 - DNA, 46 bp, Artificial Sequence
  Synthesized adaptor oligonucleotide
  misc_feature (34)..(36): n is a, c, g, or t
tgcaggaccagagaattcgaatacagacctcaannngatcgacatg

SEQ ID NO: 6901 - DNA, 46 bp, Artificial Sequence
  Synthesized adaptor oligonucleotide
  misc_feature (34)..(36): n is a, c, g, or t
tgcaggaccagagaattcgaatacaaataactcnnngatcgacatg

SEQ ID NO: 6902 - DNA, 46 bp, Artificial Sequence
  Synthesized adaptor oligonucleotide
  misc_feature (34)..(36): n is a, c, g, or t
tgcaggaccagagaattcgaatacatcatattcnnngatcgacatg

SEQ ID NO: 6903 - DNA, 46 bp, Artificial Sequence
  Synthesized adaptor oligonucleotide
  misc_feature (34)..(36): n is a, c, g, or t
tgcaggaccagagaattcgaatacagatagaatnnngatcgacatg

SEQ ID NO: 6904 - DNA, 46 bp, Artificial Sequence
  Synthesized adaptor oligonucleotide
  misc_feature (34)..(36): n is a, c, g, or t
tgcaggaccagagaattcgaatacacctggacgnnngatcgacatg

SEQ ID NO: 6905 - DNA, 46 bp, Artificial Sequence
  Synthesized adaptor oligonucleotide
  misc_feature (34)..(36): n is a, c, g, or t
tgcaggaccagagaattcgaatacataacccagnnngatcgacatg

SEQ ID NO: 6906 - DNA, 46 bp, Artificial Sequence
  Synthesized adaptor oligonucleotide
  misc_feature (34)..(36): n is a, c, g, or t
tgcaggaccagagaattcgaatacagcagccgtnnngatcgacatg

SEQ ID NO: 6907 - DNA, 46 bp, Artificial Sequence
  Synthesized adaptor oligonucleotide
  misc_feature (34)..(36): n is a, c, g, or t
tgcaggaccagagaattcgaatacacagaccgcnnngatcgacatg

SEQ ID NO: 6908 - DNA, 46 bp, Artificial Sequence
  Synthesized adaptor oligonucleotide
  misc_feature (34)..(36): n is a, c, g, or t
tgcaggaccagagaattcgaatacattaagaagnnngatcgacatg

SEQ ID NO: 6909 - DNA, 46 bp, Artificial Sequence
  Synthesized adaptor oligonucleotide
  misc_feature (34)..(36): n is a, c, g, or t
tgcaggaccagagaattcgaatacattcataagnnntgcatcaggt

SEQ ID NO: 6910 - DNA, 46 bp, Artificial Sequence
  Synthesized adaptor oligonucleotide
  misc_feature (34)..(36): n is a, c, g, or t
tgcaggaccagagaattcgaatacaccacaggcnnntgcatcaggt

SEQ ID NO: 6911 - DNA, 46 bp, Artificial Sequence
  Synthesized adaptor oligonucleotide
  misc_feature (34)..(36): n is a, c, g, or t
tgcaggaccagagaattcgaatacagtcaggccnnntgcatcaggt

SEQ ID NO: 6912 - DNA, 46 bp, Artificial Sequence
  Synthesized adaptor oligonucleotide
  misc_feature (34)..(36): n is a, c, g, or t
tgcaggaccagagaattcgaatacagtcggcacnnntgcatcaggt

SEQ ID NO: 6913 - DNA, 46 bp, Artificial Sequence
  Synthesized adaptor oligonucleotide
  misc_feature (34)..(36): n is a, c, g, or t
tgcaggaccagagaattcgaatacatagtctggnnntgcatcaggt

SEQ ID NO: 6914 - DNA, 46 bp, Artificial Sequence
  Synthesized adaptor oligonucleotide
  misc_feature (34)..(36): n is a, c, g, or t
tgcaggaccagagaattcgaatacacattattcnnntgcatcaggt

SEQ ID NO: 6915 - DNA, 46 bp, Artificial Sequence
  Synthesized adaptor oligonucleotide
  misc_feature (34)..(36): n is a, c, g, or t
tgcaggaccagagaattcgaatacagaagaccannntgcatcaggt

SEQ ID NO: 6916 - DNA, 46 bp, Artificial Sequence
  Synthesized adaptor oligonucleotide
  misc_feature (34)..(36): n is a, c, g, or t
tgcaggaccagagaattcgaatacaaattctctnnntgcatcaggt

SEQ ID NO: 6917 - DNA, 46 bp, Artificial Sequence
  Synthesized adaptor oligonucleotide
  misc_feature (34)..(36): n is a, c, g, or t
tgcaggaccagagaattcgaatacagccatcggnnntgcatcaggt

SEQ ID NO: 6918 - DNA, 46 bp, Artificial Sequence
  Synthesized adaptor oligonucleotide
  misc_feature (34)..(36): n is a, c, g, or t
tgcaggaccagagaattcgaatacatataattannntgcatcaggt

SEQ ID NO: 6919 - DNA, 46 bp, Artificial Sequence
  Synthesized adaptor oligonucleotide
  misc_feature (34)..(36): n is a, c, g, or t
tgcaggaccagagaattcgaatacaacgaacagnnntgcatcaggt

SEQ ID NO: 6920 - DNA, 46 bp, Artificial Sequence
  Synthesized adaptor oligonucleotide
  misc_feature (34)..(36): n is a, c, g, or t
tgcaggaccagagaattcgaatacaaggcccgtnnntgcatcaggt

SEQ ID NO: 6921 - DNA, 46 bp, Artificial Sequence
  Synthesized adaptor oligonucleotide
  misc_feature (34)..(36): n is a, c, g, or t
tgcaggaccagagaattcgaatacacaaagagcnnntgcatcaggt

SEQ ID NO: 6922 - DNA, 46 bp, Artificial Sequence
  Synthesized adaptor oligonucleotide
  misc_feature (34)..(36): n is a, c, g, or t
tgcaggaccagagaattcgaatacattcaggacnnntgcatcaggt

SEQ ID NO: 6923 - DNA, 46 bp, Artificial Sequence
  Synthesized adaptor oligonucleotide
  misc_feature (34)..(36): n is a, c, g, or t
tgcaggaccagagaattcgaatacaagcacgccnnntgcatcaggt

SEQ ID NO: 6924 - DNA, 46 bp, Artificial Sequence
  Synthesized adaptor oligonucleotide
  misc_feature (34)..(36): n is a, c, g, or t
tgcaggaccagagaattcgaatacagacacatcnnntgcatcaggt

SEQ ID NO: 6925 - DNA, 46 bp, Artificial Sequence
  Synthesized adaptor oligonucleotide
  misc_feature (34)..(36): n is a, c, g, or t
tgcaggaccagagaattcgaatacacgatacacnnntgcatcaggt

SEQ ID NO: 6926 - DNA, 46 bp, Artificial Sequence
  Synthesized adaptor oligonucleotide
  misc_feature (34)..(36): n is a, c, g, or t
tgcaggaccagagaattcgaatacaatacgcgtnnntgcatcaggt

SEQ ID NO: 6927 - DNA, 46 bp, Artificial Sequence
  Synthesized adaptor oligonucleotide
  misc_feature (34)..(36): n is a, c, g, or t
tgcaggaccagagaattcgaatacatacacgcannntgcatcaggt

SEQ ID NO: 6928 - DNA, 46 bp, Artificial Sequence
  Synthesized adaptor oligonucleotide
  misc_feature (34)..(36): n is a, c, g, or t
tgcaggaccagagaattcgaatacactctctctnnntgcatcaggt

SEQ ID NO: 6929 - DNA, 46 bp, Artificial Sequence
  Synthesized adaptor oligonucleotide
  misc_feature (34)..(36): n is a, c, g, or t
tgcaggaccagagaattcgaatacacaatgaggnnntgcatcaggt

SEQ ID NO: 6930 - DNA, 46 bp, Artificial Sequence
  Synthesized adaptor oligonucleotide
  misc_feature (34)..(36): n is a, c, g, or t
tgcaggaccagagaattcgaatacacacagtgtnnntgcatcaggt

SEQ ID NO: 6931 - DNA, 46 bp, Artificial Sequence
  Synthesized adaptor oligonucleotide
  misc_feature (34)..(36): n is a, c, g, or t
tgcaggaccagagaattcgaatacaaacatactnnntgcatcaggt

SEQ ID NO: 6932 - DNA, 46 bp, Artificial Sequence
  Synthesized adaptor oligonucleotide
  misc_feature (34)..(36): n is a, c, g, or t
tgcaggaccagagaattcgaatacacggcatcgnnntgcatcaggt

SEQ ID NO: 6933 - DNA, 46 bp, Artificial Sequence
  Synthesized adaptor oligonucleotide
  misc_feature (34)..(36): n is a, c, g, or t
tgcaggaccagagaattcgaatacaagtagatannntgcatcaggt

SEQ ID NO: 6934 - DNA, 46 bp, Artificial Sequence
  Synthesized adaptor oligonucleotide
  misc_feature (34)..(36): n is a, c, g, or t
tgcaggaccagagaattcgaatacagcgatccgnnntgcatcaggt

SEQ ID NO: 6935 - DNA, 46 bp, Artificial Sequence
  Synthesized adaptor oligonucleotide
  misc_feature (34)..(36): n is a, c, g, or t
tgcaggaccagagaattcgaatacaattaaattnnntgcatcaggt

SEQ ID NO: 6936 - DNA, 46 bp, Artificial Sequence
  Synthesized adaptor oligonucleotide
  misc_feature (34)..(36): n is a, c, g, or t
tgcaggaccagagaattcgaatacaagattcatnnntgcatcaggt

SEQ ID NO: 6937 - DNA, 46 bp, Artificial Sequence
  Synthesized adaptor oligonucleotide
  misc_feature (34)..(36): n is a, c, g, or t
tgcaggaccagagaattcgaatacatcacctgtnnntgcatcaggt

SEQ ID NO: 6938 - DNA, 46 bp, Artificial Sequence
  Synthesized adaptor oligonucleotide
  misc_feature (34)..(36): n is a, c, g, or t
tgcaggaccagagaattcgaatacacaaatactnnntgcatcaggt

SEQ ID NO: 6939 - DNA, 46 bp, Artificial Sequence
  Synthesized adaptor oligonucleotide
  misc_feature (34)..(36): n is a, c, g, or t
tgcaggaccagagaattcgaatacatttagcaannntgcatcaggt

SEQ ID NO: 6940 - DNA, 46 bp, Artificial Sequence
  Synthesized adaptor oligonucleotide
  misc_feature (34)..(36): n is a, c, g, or t
tgcaggaccagagaattcgaatacatcctagtcnnntgcatcaggt

SEQ ID NO: 6941 - DNA, 46 bp, Artificial Sequence
  Synthesized adaptor oligonucleotide
  misc_feature (34)..(36): n is a, c, g, or t
tgcaggaccagagaattcgaatacataaagagtnnntgcatcaggt

SEQ ID NO: 6942 - DNA, 46 bp, Artificial Sequence
  Synthesized adaptor oligonucleotide
  misc_feature (34)..(36): n is a, c, g, or t
tgcaggaccagagaattcgaatacacatgcacannntgcatcaggt

SEQ ID NO: 6943 - DNA, 46 bp, Artificial Sequence
  Synthesized adaptor oligonucleotide
  misc_feature (34)..(36): n is a, c, g, or t
tgcaggaccagagaattcgaatacatttcaactnnntgcatcaggt

SEQ ID NO: 6944 - DNA, 46 bp, Artificial Sequence
  Synthesized adaptor oligonucleotide
  misc_feature (34)..(36): n is a, c, g, or t
tgcaggaccagagaattcgaatacactgatgtgnnntgcatcaggt

SEQ ID NO: 6945 - DNA, 46 bp, Artificial Sequence
  Synthesized adaptor oligonucleotide
  misc_feature (34)..(36): n is a, c, g, or t
tgcaggaccagagaattcgaatacacccgttcgnnntgcatcaggt

SEQ ID NO: 6946 - DNA, 46 bp, Artificial Sequence
  Synthesized adaptor oligonucleotide
  misc_feature (34)..(36): n is a, c, g, or t
tgcaggaccagagaattcgaatacacataagaannntgcatcaggt

SEQ ID NO: 6947 - DNA, 46 bp, Artificial Sequence
  Synthesized adaptor oligonucleotide
  misc_feature (34)..(36): n is a, c, g, or t
tgcaggaccagagaattcgaatacagattacgcnnntgcatcaggt

SEQ ID NO: 6948 - DNA, 46 bp, Artificial Sequence
  Synthesized adaptor oligonucleotide
  misc_feature (34)..(36): n is a, c, g, or t
tgcaggaccagagaattcgaatacactgacgatnnntgcatcaggt

SEQ ID NO: 6949 - DNA, 46 bp, Artificial Sequence
  Synthesized adaptor oligonucleotide
  misc_feature (34)..(36): n is a, c, g, or t
tgcaggaccagagaattcgaatacaactttctannntgcatcaggt

SEQ ID NO: 6950 - DNA, 46 bp, Artificial Sequence
  Synthesized adaptor oligonucleotide
  misc_feature (34)..(36): n is a, c, g, or t
tgcaggaccagagaattcgaatacacacatagcnnntgcatcaggt

SEQ ID NO: 6951 - DNA, 46 bp, Artificial Sequence
  Synthesized adaptor oligonucleotide
  misc_feature (34)..(36): n is a, c, g, or t
tgcaggaccagagaattcgaatacattagtcaannntgcatcaggt

SEQ ID NO: 6952 - DNA, 46 bp, Artificial Sequence
  Synthesized adaptor oligonucleotide
  misc_feature (34)..(36): n is a, c, g, or t
tgcaggaccagagaattcgaatacatggtcgcgnnntgcatcaggt

SEQ ID NO: 6953 - DNA, 46 bp, Artificial Sequence
  Synthesized adaptor oligonucleotide
  misc_feature (34)..(36): n is a, c, g, or t
tgcaggaccagagaattcgaatacattctgaccnnntgcatcaggt

SEQ ID NO: 6954 - DNA, 46 bp, Artificial Sequence
  Synthesized adaptor oligonucleotide
  misc_feature (34)..(36): n is a, c, g, or t
tgcaggaccagagaattcgaatacataaaacctnnntgcatcaggt

SEQ ID NO: 6955 - DNA, 46 bp, Artificial Sequence
  Synthesized adaptor oligonucleotide
  misc_feature (34)..(36): n is a, c, g, or t
tgcaggaccagagaattcgaatacaactataacnnntgcatcaggt

SEQ ID NO: 6956 - DNA, 46 bp, Artificial Sequence
  Synthesized adaptor oligonucleotide
  misc_feature (34)..(36): n is a, c, g, or t
tgcaggaccagagaattcgaatacatatgatgtnnntgcatcaggt

SEQ ID NO: 6957 - DNA, 46 bp, Artificial Sequence
  Synthesized adaptor oligonucleotide
  misc_feature (34)..(36): n is a, c, g, or t
tgcaggaccagagaattcgaatacatcaccgccnnntgcatcaggt

SEQ ID NO: 6958 - DNA, 46 bp, Artificial Sequence
  Synthesized adaptor oligonucleotide
  misc_feature (34)..(36): n is a, c, g, or t
tgcaggaccagagaattcgaatacaaggttattnnntgcatcaggt

SEQ ID NO: 6959 - DNA, 46 bp, Artificial Sequence
  Synthesized adaptor oligonucleotide
  misc_feature (34)..(36): n is a, c, g, or t
tgcaggaccagagaattcgaatacaagcagcttnnntgcatcaggt

SEQ ID NO: 6960 - DNA, 46 bp, Artificial Sequence
  Synthesized adaptor oligonucleotide
  misc_feature (34)..(36): n is a, c, g, or t
tgcaggaccagagaattcgaatacatcgagactnnntgcatcaggt

SEQ ID NO: 6961 - DNA, 46 bp, Artificial Sequence
  Synthesized adaptor oligonucleotide
  misc_feature (34)..(36): n is a, c, g, or t
tgcaggaccagagaattcgaatacacacacttcnnntgcatcaggt

SEQ ID NO: 6962 - DNA, 46 bp, Artificial Sequence
  Synthesized adaptor oligonucleotide
  misc_feature (34)..(36): n is a, c, g, or t
tgcaggaccagagaattcgaatacaaaaaaaccnnntgcatcaggt

SEQ ID NO: 6963 - DNA, 46 bp, Artificial Sequence
  Synthesized adaptor oligonucleotide
  misc_feature (34)..(36): n is a, c, g, or t
tgcaggaccagagaattcgaatacatacagccannntgcatcaggt

SEQ ID NO: 6964 - DNA, 46 bp, Artificial Sequence
  Synthesized adaptor oligonucleotide
  misc_feature (34)..(36): n is a, c, g, or t
tgcaggaccagagaattcgaatacaatgaaaacnnntgcatcaggt

SEQ ID NO: 6965 - DNA, 46 bp, Artificial Sequence
  Synthesized adaptor oligonucleotide
  misc_feature (34)..(36): n is a, c, g, or t
tgcaggaccagagaattcgaatacagtgatgctnnntgcatcaggt

SEQ ID NO: 6966 - DNA, 46 bp, Artificial Sequence
  Synthesized adaptor oligonucleotide
  misc_feature (34)..(36): n is a, c, g, or t
tgcaggaccagagaattcgaatacattaacagtnnntgcatcaggt

SEQ ID NO: 6967 - DNA, 46 bp, Artificial Sequence
  Synthesized adaptor oligonucleotide
  misc_feature (34)..(36): n is a, c, g, or t
tgcaggaccagagaattcgaatacacaaccgcgnnntgcatcaggt

SEQ ID NO: 6968 - DNA, 46 bp, Artificial Sequence
  Synthesized adaptor oligonucleotide
  misc_feature (34)..(36): n is a, c, g, or t
tgcaggaccagagaattcgaatacatgtgccccnnntgcatcaggt

SEQ ID NO: 6969 - DNA, 46 bp, Artificial Sequence
  Synthesized adaptor oligonucleotide
  misc_feature (34)..(36): n is a, c, g, or t
tgcaggaccagagaattcgaatacatattcgttnnnacgtatgcca

SEQ ID NO: 6970 - DNA, 46 bp, Artificial Sequence
  Synthesized adaptor oligonucleotide
  misc_feature (34)..(36): n is a, c, g, or t
tgcaggaccagagaattcgaatacaccattaaannnacgtatgcca

SEQ ID NO: 6971 - DNA, 46 bp, Artificial Sequence
  Synthesized adaptor oligonucleotide
  misc_feature (34)..(36): n is a, c, g, or t
tgcaggaccagagaattcgaatacagttggcgcnnnacgtatgcca

SEQ ID NO: 6972 - DNA, 46 bp, Artificial Sequence
  Synthesized adaptor oligonucleotide
  misc_feature (34)..(36): n is a, c, g, or t
tgcaggaccagagaattcgaatacactggcgtgnnnacgtatgcca

SEQ ID NO: 6973 - DNA, 46 bp, Artificial Sequence
  Synthesized adaptor oligonucleotide
  misc_feature (34)..(36): n is a, c, g, or t
tgcaggaccagagaattcgaatacaaatacccgnnnacgtatgcca

SEQ ID NO: 6974 - DNA, 46 bp, Artificial Sequence
  Synthesized adaptor oligonucleotide
  misc_feature (34)..(36): n is a, c, g, or t
tgcaggaccagagaattcgaatacacacaaaccnnnacgtatgcca

SEQ ID NO: 6975 - DNA, 46 bp, Artificial Sequence
  Synthesized adaptor oligonucleotide
  misc_feature (34)..(36): n is a, c, g, or t
tgcaggaccagagaattcgaatacaattaatatnnnacgtatgcca

SEQ ID NO: 6976 - DNA, 46 bp, Artificial Sequence
  Synthesized adaptor oligonucleotide
  misc_feature (34)..(36): n is a, c, g, or t
tgcaggaccagagaattcgaatacagattagccnnnacgtatgcca

SEQ ID NO: 6977 - DNA, 46 bp, Artificial Sequence
  Synthesized adaptor oligonucleotide
  misc_feature (34)..(36): n is a, c, g, or t
tgcaggaccagagaattcgaatacagacaaaatnnnacgtatgcca

SEQ ID NO: 6978 - DNA, 46 bp, Artificial Sequence
  Synthesized adaptor oligonucleotide
  misc_feature (34)..(36): n is a, c, g, or t
tgcaggaccagagaattcgaatacaaatatttannnacgtatgcca

SEQ ID NO: 6979 - DNA, 46 bp, Artificial Sequence
  Synthesized adaptor oligonucleotide
  misc_feature (34)..(36): n is a, c, g, or t
tgcaggaccagagaattcgaatacaaaaagtcannnacgtatgcca

SEQ ID NO: 6980 - DNA, 46 bp, Artificial Sequence
  Synthesized adaptor oligonucleotide
  misc_feature (34)..(36): n is a, c, g, or t
tgcaggaccagagaattcgaatacagtctataannnacgtatgcca

SEQ ID NO: 6981 - DNA, 46 bp, Artificial Sequence
  Synthesized adaptor oligonucleotide
  misc_feature (34)..(36): n is a, c, g, or t
tgcaggaccagagaattcgaatacaaaaaacgtnnnacgtatgcca

SEQ ID NO: 6982 - DNA, 46 bp, Artificial Sequence
  Synthesized adaptor oligonucleotide
  misc_feature (34)..(36): n is a, c, g, or t
tgcaggaccagagaattcgaatacattgctctgnnnacgtatgcca

SEQ ID NO: 6983 - DNA, 46 bp, Artificial Sequence
  Synthesized adaptor oligonucleotide
  misc_feature (34)..(36): n is a, c, g, or t
tgcaggaccagagaattcgaatacaatgatgaannnacgtatgcca

SEQ ID NO: 6984 - DNA, 46 bp, Artificial Sequence
  Synthesized adaptor oligonucleotide
  misc_feature (34)..(36): n is a, c, g, or t
tgcaggaccagagaattcgaatacatccctgtannnacgtatgcca

SEQ ID NO: 6985 - DNA, 46 bp, Artificial Sequence
  Synthesized adaptor oligonucleotide
  misc_feature (34)..(36): n is a, c, g, or t
tgcaggaccagagaattcgaatacaacatccgannnacgtatgcca

SEQ ID NO: 6986 - DNA, 46 bp, Artificial Sequence
  Synthesized adaptor oligonucleotide
  misc_feature (34)..(36): n is a, c, g, or t
tgcaggaccagagaattcgaatacattagatcannnacgtatgcca

SEQ ID NO: 6987 - DNA, 46 bp, Artificial Sequence
  Synthesized adaptor oligonucleotide
  misc_feature (34)..(36): n is a, c, g, or t
tgcaggaccagagaattcgaatacacgcctaccnnnacgtatgcca

SEQ ID NO: 6988 - DNA, 46 bp, Artificial Sequence
  Synthesized adaptor oligonucleotide
  misc_feature (34)..(36): n is a, c, g, or t
tgcaggaccagagaattcgaatacactctaaccnnnacgtatgcca

SEQ ID NO: 6989 - DNA, 46 bp, Artificial Sequence
  Synthesized adaptor oligonucleotide
  misc_feature (34)..(36): n is a, c, g, or t
tgcaggaccagagaattcgaatacacgtcatctnnnacgtatgcca

SEQ ID NO: 6990 - DNA, 46 bp, Artificial Sequence
  Synthesized adaptor oligonucleotide
  misc_feature (34)..(36): n is a, c, g, or t
tgcaggaccagagaattcgaatacacacctatcnnnacgtatgcca

SEQ ID NO: 6991 - DNA, 46 bp, Artificial Sequence
  Synthesized adaptor oligonucleotide
  misc_feature (34)..(36): n is a, c, g, or t
tgcaggaccagagaattcgaatacatcgctatcnnnacgtatgcca

SEQ ID NO: 6992 - DNA, 46 bp, Artificial Sequence
  Synthesized adaptor oligonucleotide
  misc_feature (34)..(36): n is a, c, g, or t
tgcaggaccagagaattcgaatacagaaggccgnnnacgtatgcca

SEQ ID NO: 6993 - DNA, 46 bp, Artificial Sequence
  Synthesized adaptor oligonucleotide
  misc_feature (34)..(36): n is a, c, g, or t
tgcaggaccagagaattcgaatacagttttcgcnnnacgtatgcca

SEQ ID NO: 6994 - DNA, 46 bp, Artificial Sequence
  Synthesized adaptor oligonucleotide
  misc_feature (34)..(36): n is a, c, g, or t
tgcaggaccagagaattcgaatacaagtggcccnnnacgtatgcca

SEQ ID NO: 6995 - DNA, 46 bp, Artificial Sequence
  Synthesized adaptor oligonucleotide
  misc_feature (34)..(36): n is a, c, g, or t
tgcaggaccagagaattcgaatacaagccatacnnnacgtatgcca

SEQ ID NO: 6996 - DNA, 46 bp, Artificial Sequence
  Synthesized adaptor oligonucleotide
  misc_feature (34)..(36): n is a, c, g, or t
tgcaggaccagagaattcgaatacaattccgagnnnacgtatgcca

SEQ ID NO: 6997 - DNA, 46 bp, Artificial Sequence
  Synthesized adaptor oligonucleotide
  misc_feature (34)..(36): n is a, c, g, or t
tgcaggaccagagaattcgaatacacaaccgatnnnacgtatgcca

SEQ ID NO: 6998 - DNA, 46 bp, Artificial Sequence
  Synthesized adaptor oligonucleotide
  misc_feature (34)..(36): n is a, c, g, or t
tgcaggaccagagaattcgaatacaaagtatgannnacgtatgcca

SEQ ID NO: 6999 - DNA, 46 bp, Artificial Sequence
  Synthesized adaptor oligonucleotide
  misc_feature (34)..(36): n is a, c, g, or t
tgcaggaccagagaattcgaatacaatctgcctnnnacgtatgcca

SEQ ID NO: 7000 - DNA, 46 bp, Artificial Sequence
  Synthesized adaptor oligonucleotide
  misc_feature (34)..(36): n is a, c, g, or t
tgcaggaccagagaattcgaatacactcatttannnacgtatgcca

SEQ ID NO: 7001 - DNA, 46 bp, Artificial Sequence
  Synthesized adaptor oligonucleotide
  misc_feature (34)..(36): n is a, c, g, or t
tgcaggaccagagaattcgaatacataaatcacnnnacgtatgcca

SEQ ID NO: 7002 - DNA, 46 bp, Artificial Sequence
  Synthesized adaptor oligonucleotide
  misc_feature (34)..(36): n is a, c, g, or t
tgcaggaccagagaattcgaatacaccgagaccnnnacgtatgcca

SEQ ID NO: 7003 - DNA, 46 bp, Artificial Sequence
  Synthesized adaptor oligonucleotide
  misc_feature (34)..(36): n is a, c, g, or t
tgcaggaccagagaattcgaatacatcgcccacnnnacgtatgcca

SEQ ID NO: 7004 - DNA, 46 bp, Artificial Sequence
  Synthesized adaptor oligonucleotide
  misc_feature (34)..(36): n is a, c, g, or t
tgcaggaccagagaattcgaatacaacgacttgnnnacgtatgcca

SEQ ID NO: 7005 - DNA, 46 bp, Artificial Sequence
  Synthesized adaptor oligonucleotide
  misc_feature (34)..(36): n is a, c, g, or t
tgcaggaccagagaattcgaatacagtttagcgnnnacgtatgcca

SEQ ID NO: 7006 - DNA, 46 bp, Artificial Sequence
  Synthesized adaptor oligonucleotide
  misc_feature (34)..(36): n is a, c, g, or t
tgcaggaccagagaattcgaatacagtttcaaannnacgtatgcca

SEQ ID NO: 7007 - DNA, 46 bp, Artificial Sequence
  Synthesized adaptor oligonucleotide
  misc_feature (34)..(36): n is a, c, g, or t
tgcaggaccagagaattcgaatacagaatgcgannnacgtatgcca

SEQ ID NO: 7008 - DNA, 46 bp, Artificial Sequence
  Synthesized adaptor oligonucleotide
  misc_feature (34)..(36): n is a, c, g, or t
tgcaggaccagagaattcgaatacaacccgtaannnacgtatgcca

SEQ ID NO: 7009 - DNA, 46 bp, Artificial Sequence
  Synthesized adaptor oligonucleotide
  misc_feature (34)..(36): n is a, c, g, or t
tgcaggaccagagaattcgaatacagtcaccaannnacgtatgcca

SEQ ID NO: 7010 - DNA, 46 bp, Artificial Sequence
  Synthesized adaptor oligonucleotide
  misc_feature (34)..(36): n is a, c, g, or t
tgcaggaccagagaattcgaatacattggactgnnnacgtatgcca

SEQ ID NO: 7011 - DNA, 46 bp, Artificial Sequence
  Synthesized adaptor oligonucleotide
  misc_feature (34)..(36): n is a, c, g, or t
tgcaggaccagagaattcgaatacaaagcttgcnnnacgtatgcca

SEQ ID NO: 7012 - DNA, 46 bp, Artificial Sequence
  Synthesized adaptor oligonucleotide
  misc_feature (34)..(36): n is a, c, g, or t
tgcaggaccagagaattcgaatacattatttatnnnacgtatgcca

SEQ ID NO: 7013 - DNA, 46 bp, Artificial Sequence
  Synthesized adaptor oligonucleotide
  misc_feature (34)..(36): n is a, c, g, or t
tgcaggaccagagaattcgaatacatacaatgtnnnacgtatgcca

SEQ ID NO: 7014 - DNA, 46 bp, Artificial Sequence
  Synthesized adaptor oligonucleotide
  misc_feature (34)..(36): n is a, c, g, or t
tgcaggaccagagaattcgaatacaaaagtggcnnnacgtatgcca

SEQ ID NO: 7015 - DNA, 46 bp, Artificial Sequence
  Synthesized adaptor oligonucleotide
  misc_feature (34)..(36): n is a, c, g, or t
tgcaggaccagagaattcgaatacagctgctccnnnacgtatgcca

SEQ ID NO: 7016 - DNA, 46 bp, Artificial Sequence
  Synthesized adaptor oligonucleotide
  misc_feature (34)..(36): n is a, c, g, or t
tgcaggaccagagaattcgaatacagctgatacnnnacgtatgcca

SEQ ID NO: 7017 - DNA, 46 bp, Artificial Sequence
  Synthesized adaptor oligonucleotide
  misc_feature (34)..(36): n is a, c, g, or t
tgcaggaccagagaattcgaatacactttgattnnnacgtatgcca

SEQ ID NO: 7018 - DNA, 46 bp, Artificial Sequence
  Synthesized adaptor oligonucleotide
  misc_feature (34)..(36): n is a, c, g, or t
tgcaggaccagagaattcgaatacacttgtgagnnnacgtatgcca

SEQ ID NO: 7019 - DNA, 46 bp, Artificial Sequence
  Synthesized adaptor oligonucleotide
  misc_feature (34)..(36): n is a, c, g, or t
tgcaggaccagagaattcgaatacaacttccgtnnnacgtatgcca

SEQ ID NO: 7020 - DNA, 46 bp, Artificial Sequence
  Synthesized adaptor oligonucleotide
  misc_feature (34)..(36): n is a, c, g, or t
tgcaggaccagagaattcgaatacacaagatccnnnacgtatgcca

SEQ ID NO: 7021 - DNA, 46 bp, Artificial Sequence
  Synthesized adaptor oligonucleotide
  misc_feature (34)..(36): n is a, c, g, or t
tgcaggaccagagaattcgaatacagtcgcctcnnnacgtatgcca

SEQ ID NO: 7022 - DNA, 46 bp, Artificial Sequence
  Synthesized adaptor oligonucleotide
  misc_feature (34)..(36): n is a, c, g, or t
tgcaggaccagagaattcgaatacagtggtgaannnacgtatgcca

SEQ ID NO: 7023 - DNA, 46 bp, Artificial Sequence
  Synthesized adaptor oligonucleotide
  misc_feature (34)..(36): n is a, c, g, or t
tgcaggaccagagaattcgaatacaagtaagtannnacgtatgcca

SEQ ID NO: 7024 - DNA, 46 bp, Artificial Sequence
  Synthesized adaptor oligonucleotide
  misc_feature (34)..(36): n is a, c, g, or t
tgcaggaccagagaattcgaatacaatttatttnnnacgtatgcca

SEQ ID NO: 7025 - DNA, 46 bp, Artificial Sequence
  Synthesized adaptor oligonucleotide
  misc_feature (34)..(36): n is a, c, g, or t
tgcaggaccagagaattcgaatacaggaatcgannnacgtatgcca

SEQ ID NO: 7026 - DNA, 46 bp, Artificial Sequence
  Synthesized adaptor oligonucleotide
  misc_feature (34)..(36): n is a, c, g, or t
tgcaggaccagagaattcgaatacacgtgctttnnnacgtatgcca

SEQ ID NO: 7027 - DNA, 46 bp, Artificial Sequence
  Synthesized adaptor oligonucleotide
  misc_feature (34)..(36): n is a, c, g, or t
tgcaggaccagagaattcgaatacagttaaactnnnacgtatgcca

SEQ ID NO: 7028 - DNA, 46 bp, Artificial Sequence
  Synthesized adaptor oligonucleotide
  misc_feature (34)..(36): n is a, c, g, or t
tgcaggaccagagaattcgaatacaatcttaagnnnacgtatgcca

SEQ ID NO: 7029 - DNA, 46 bp, Artificial Sequence
  Synthesized adaptor oligonucleotide
  misc_feature (34)..(36): n is a, c, g, or t
tgcaggaccagagaattcgaatacaaactcagcnnnctagcgttac

SEQ ID NO: 7030 - DNA, 46 bp, Artificial Sequence
  Synthesized adaptor oligonucleotide
  misc_feature (34)..(36): n is a, c, g, or t
tgcaggaccagagaattcgaatacaacgaaagcnnnctagcgttac

SEQ ID NO: 7031 - DNA, 46 bp, Artificial Sequence
  Synthesized adaptor oligonucleotide
  misc_feature (34)..(36): n is a, c, g, or t
tgcaggaccagagaattcgaatacagcgtaatcnnnctagcgttac

SEQ ID NO: 7032 - DNA, 46 bp, Artificial Sequence
  Synthesized adaptor oligonucleotide
  misc_feature (34)..(36): n is a, c, g, or t
tgcaggaccagagaattcgaatacaaggtggtannnctagcgttac

SEQ ID NO: 7033 - DNA, 46 bp, Artificial Sequence
  Synthesized adaptor oligonucleotide
  misc_feature (34)..(36): n is a, c, g, or t
tgcaggaccagagaattcgaatacacttgagtgnnnctagcgttac

SEQ ID NO: 7034 - DNA, 46 bp, Artificial Sequence
  Synthesized adaptor oligonucleotide
  misc_feature (34)..(36): n is a, c, g, or t
tgcaggaccagagaattcgaatacactcgccgtnnnctagcgttac

SEQ ID NO: 7035 - DNA, 46 bp, Artificial Sequence
  Synthesized adaptor oligonucleotide
  misc_feature (34)..(36): n is a, c, g, or t
tgcaggaccagagaattcgaatacaggcctaatnnnctagcgttac

SEQ ID NO: 7036 - DNA, 46 bp, Artificial Sequence
  Synthesized adaptor oligonucleotide
  misc_feature (34)..(36): n is a, c, g, or t
tgcaggaccagagaattcgaatacaaccccctgnnnctagcgttac

SEQ ID NO: 7037 - DNA, 46 bp, Artificial Sequence
  Synthesized adaptor oligonucleotide
  misc_feature (34)..(36): n is a, c, g, or t
tgcaggaccagagaattcgaatacaccctatcannnctagcgttac

SEQ ID NO: 7038 - DNA, 46 bp, Artificial Sequence
  Synthesized adaptor oligonucleotide
  misc_feature (34)..(36): n is a, c, g, or t
tgcaggaccagagaattcgaatacatagaacaannnctagcgttac

SEQ ID NO: 7039 - DNA, 46 bp, Artificial Sequence
  Synthesized adaptor oligonucleotide
  misc_feature (34)..(36): n is a, c, g, or t
tgcaggaccagagaattcgaatacaccggaggannnctagcgttac

SEQ ID NO: 7040 - DNA, 46 bp, Artificial Sequence
  Synthesized adaptor oligonucleotide
  misc_feature (34)..(36): n is a, c, g, or t
tgcaggaccagagaattcgaatacaatgaacaannnctagcgttac

SEQ ID NO: 7041 - DNA, 46 bp, Artificial Sequence
  Synthesized adaptor oligonucleotide
  misc_feature (34)..(36): n is a, c, g, or t
tgcaggaccagagaattcgaatacattcgaagcnnnctagcgttac

SEQ ID NO: 7042 - DNA, 46 bp, Artificial Sequence
  Synthesized adaptor oligonucleotide
  misc_feature (34)..(36): n is a, c, g, or t
tgcaggaccagagaattcgaatacaaacaacaannnctagcgttac

SEQ ID NO: 7043 - DNA, 46 bp, Artificial Sequence
  Synthesized adaptor oligonucleotide
  misc_feature (34)..(36): n is a, c, g, or t
tgcaggaccagagaattcgaatacatcctttggnnnctagcgttac

SEQ ID NO: 7044 - DNA, 46 bp, Artificial Sequence
  Synthesized adaptor oligonucleotide
  misc_feature (34)..(36): n is a, c, g, or t
tgcaggaccagagaattcgaatacaaaacgaatnnnctagcgttac

SEQ ID NO: 7045 - DNA, 46 bp, Artificial Sequence
  Synthesized adaptor oligonucleotide
  misc_feature (34)..(36): n is a, c, g, or t
tgcaggaccagagaattcgaatacatccagtgannnctagcgttac

SEQ ID NO: 7046 - DNA, 46 bp, Artificial Sequence
  Synthesized adaptor oligonucleotide
  misc_feature (34)..(36): n is a, c, g, or t
tgcaggaccagagaattcgaatacacttcaaaannnctagcgttac

SEQ ID NO: 7047 - DNA, 46 bp, Artificial Sequence
  Synthesized adaptor oligonucleotide
  misc_feature (34)..(36): n is a, c, g, or t
tgcaggaccagagaattcgaatacatatctagannnctagcgttac

SEQ ID NO: 7048 - DNA, 46 bp, Artificial Sequence
  Synthesized adaptor oligonucleotide
  misc_feature (34)..(36): n is a, c, g, or t
tgcaggaccagagaattcgaatacaaacggcttnnnctagcgttac

SEQ ID NO: 7049 - DNA, 46 bp, Artificial Sequence
  Synthesized adaptor oligonucleotide
  misc_feature (34)..(36): n is a, c, g, or t
tgcaggaccagagaattcgaatacaacttttcannnctagcgttac

SEQ ID NO: 7050 - DNA, 46 bp, Artificial Sequence
  Synthesized adaptor oligonucleotide
  misc_feature (34)..(36): n is a, c, g, or t
tgcaggaccagagaattcgaatacaagtgcttgnnnctagcgttac

SEQ ID NO: 7051 - DNA, 46 bp, Artificial Sequence
  Synthesized adaptor oligonucleotide
  misc_feature (34)..(36): n is a, c, g, or t
tgcaggaccagagaattcgaatacaatggtccannnctagcgttac

SEQ ID NO: 7052 - DNA, 46 bp, Artificial Sequence
  Synthesized adaptor oligonucleotide
  misc_feature (34)..(36): n is a, c, g, or t
tgcaggaccagagaattcgaatacagccccctannnctagcgttac

SEQ ID NO: 7053 - DNA, 46 bp, Artificial Sequence
  Synthesized adaptor oligonucleotide
  misc_feature (34)..(36): n is a, c, g, or t
tgcaggaccagagaattcgaatacagttgctctnnnctagcgttac

SEQ ID NO: 7054 - DNA, 46 bp, Artificial Sequence
  Synthesized adaptor oligonucleotide
  misc_feature (34)..(36): n is a, c, g, or t
tgcaggaccagagaattcgaatacagcatatatnnnctagcgttac

SEQ ID NO: 7055 - DNA, 46 bp, Artificial Sequence
  Synthesized adaptor oligonucleotide
  misc_feature (34)..(36): n is a, c, g, or t
tgcaggaccagagaattcgaatacaggtcttgannnctagcgttac

SEQ ID NO: 7056 - DNA, 46 bp, Artificial Sequence
  Synthesized adaptor oligonucleotide
  misc_feature (34)..(36): n is a, c, g, or t
tgcaggaccagagaattcgaatacaactatttcnnnctagcgttac

SEQ ID NO: 7057 - DNA, 46 bp, Artificial Sequence
  Synthesized adaptor oligonucleotide
  misc_feature (34)..(36): n is a, c, g, or t
tgcaggaccagagaattcgaatacacttaaaacnnnctagcgttac

SEQ ID NO: 7058 - DNA, 46 bp, Artificial Sequence
  Synthesized adaptor oligonucleotide
  misc_feature (34)..(36): n is a, c, g, or t
tgcaggaccagagaattcgaatacatcgcagcgnnnctagcgttac

SEQ ID NO: 7059 - DNA, 46 bp, Artificial Sequence
  Synthesized adaptor oligonucleotide
  misc_feature (34)..(36): n is a, c, g, or t
tgcaggaccagagaattcgaatacagattcgacnnnctagcgttac

SEQ ID NO: 7060 - DNA, 46 bp, Artificial Sequence
  Synthesized adaptor oligonucleotide
  misc_feature (34)..(36): n is a, c, g, or t
tgcaggaccagagaattcgaatacatggccgtgnnnctagcgttac

SEQ ID NO: 7061 - DNA, 46 bp, Artificial Sequence
  Synthesized adaptor oligonucleotide
  misc_feature (34)..(36): n is a, c, g, or t
tgcaggaccagagaattcgaatacaaaggcatgnnnctagcgttac

SEQ ID NO: 7062 - DNA, 46 bp, Artificial Sequence
  Synthesized adaptor oligonucleotide
  misc_feature (34)..(36): n is a, c, g, or t
tgcaggaccagagaattcgaatacaatgatctannnctagcgttac

SEQ ID NO: 7063 - DNA, 46 bp, Artificial Sequence
  Synthesized adaptor oligonucleotide
  misc_feature (34)..(36): n is a, c, g, or t
tgcaggaccagagaattcgaatacatcggcaatnnnctagcgttac

SEQ ID NO: 7064 - DNA, 46 bp, Artificial Sequence
  Synthesized adaptor oligonucleotide
  misc_feature (34)..(36): n is a, c, g, or t
tgcaggaccagagaattcgaatacaatccgcttnnnctagcgttac

SEQ ID NO: 7065 - DNA, 46 bp, Artificial Sequence
  Synthesized adaptor oligonucleotide
  misc_feature (34)..(36): n is a, c, g, or t
tgcaggaccagagaattcgaatacagaagtggtnnnctagcgttac

SEQ ID NO: 7066 - DNA, 46 bp, Artificial Sequence
  Synthesized adaptor oligonucleotide
  misc_feature (34)..(36): n is a, c, g, or t
tgcaggaccagagaattcgaatacaggaacagtnnnctagcgttac

SEQ ID NO: 7067 - DNA, 46 bp, Artificial Sequence
  Synthesized adaptor oligonucleotide
  misc_feature (34)..(36): n is a, c, g, or t
tgcaggaccagagaattcgaatacactaaacatnnnctagcgttac

SEQ ID NO: 7068 - DNA, 46 bp, Artificial Sequence
  Synthesized adaptor oligonucleotide
  misc_feature (34)..(36): n is a, c, g, or t
tgcaggaccagagaattcgaatacaaaggagtcnnnctagcgttac

SEQ ID NO: 7069 - DNA, 46 bp, Artificial Sequence
  Synthesized adaptor oligonucleotide
  misc_feature (34)..(36): n is a, c, g, or t
tgcaggaccagagaattcgaatacatccatgtcnnnctagcgttac

SEQ ID NO: 7070 - DNA, 46 bp, Artificial Sequence
  Synthesized adaptor oligonucleotide
  misc_feature (34)..(36): n is a, c, g, or t
tgcaggaccagagaattcgaatacagtacgagannnctagcgttac

SEQ ID NO: 7071 - DNA, 46 bp, Artificial Sequence
  Synthesized adaptor oligonucleotide
  misc_feature (34)..(36): n is a, c, g, or t
tgcaggaccagagaattcgaatacaggccagctnnnctagcgttac

SEQ ID NO: 7072 - DNA, 46 bp, Artificial Sequence
  Synthesized adaptor oligonucleotide
  misc_feature (34)..(36): n is a, c, g, or t
tgcaggaccagagaattcgaatacagtccgatannnctagcgttac

SEQ ID NO: 7073 - DNA, 46 bp, Artificial Sequence
  Synthesized adaptor oligonucleotide
  misc_feature (34)..(36): n is a, c, g, or t
tgcaggaccagagaattcgaatacatgttacaannnctagcgttac

SEQ ID NO: 7074 - DNA, 46 bp, Artificial Sequence
  Synthesized adaptor oligonucleotide
  misc_feature (34)..(36): n is a, c, g, or t
tgcaggaccagagaattcgaatacacattccacnnnctagcgttac

SEQ ID NO: 7075 - DNA, 46 bp, Artificial Sequence
  Synthesized adaptor oligonucleotide
  misc_feature (34)..(36): n is a, c, g, or t
tgcaggaccagagaattcgaatacatgttgaatnnnctagcgttac

SEQ ID NO: 7076 - DNA, 46 bp, Artificial Sequence
  Synthesized adaptor oligonucleotide
  misc_feature (34)..(36): n is a, c, g, or t
tgcaggaccagagaattcgaatacaagaaacgcnnnctagcgttac

SEQ ID NO: 7077 - DNA, 46 bp, Artificial Sequence
  Synthesized adaptor oligonucleotide
  misc_feature (34)..(36): n is a, c, g, or t
tgcaggaccagagaattcgaatacatccgacccnnnctagcgttac

SEQ ID NO: 7078 - DNA, 46 bp, Artificial Sequence
  Synthesized adaptor oligonucleotide
  misc_feature (34)..(36): n is a, c, g, or t
tgcaggaccagagaattcgaatacacactagtgnnnctagcgttac

SEQ ID NO: 7079 - DNA, 46 bp, Artificial Sequence
  Synthesized adaptor oligonucleotide
  misc_feature (34)..(36): n is a, c, g, or t
tgcaggaccagagaattcgaatacaaccggcgtnnnctagcgttac

SEQ ID NO: 7080 - DNA, 46 bp, Artificial Sequence
  Synthesized adaptor oligonucleotide
  misc_feature (34)..(36): n is a, c, g, or t
tgcaggaccagagaattcgaatacacttgctacnnnctagcgttac

SEQ ID NO: 7081 - DNA, 46 bp, Artificial Sequence
  Synthesized adaptor oligonucleotide
  misc_feature (34)..(36): n is a, c, g, or t
tgcaggaccagagaattcgaatacattgcagtgnnnctagcgttac

SEQ ID NO: 7082 - DNA, 46 bp, Artificial Sequence
  Synthesized adaptor oligonucleotide
  misc_feature (34)..(36): n is a, c, g, or t
tgcaggaccagagaattcgaatacaaatgaagtnnnctagcgttac

SEQ ID NO: 7083 - DNA, 46 bp, Artificial Sequence
  Synthesized adaptor oligonucleotide
  misc_feature (34)..(36): n is a, c, g, or t
tgcaggaccagagaattcgaatacactcgcccannnctagcgttac

SEQ ID NO: 7084 - DNA, 46 bp, Artificial Sequence
  Synthesized adaptor oligonucleotide
  misc_feature (34)..(36): n is a, c, g, or t
tgcaggaccagagaattcgaatacagtggacccnnnctagcgttac

SEQ ID NO: 7085 - DNA, 46 bp, Artificial Sequence
  Synthesized adaptor oligonucleotide
  misc_feature (34)..(36): n is a, c, g, or t
tgcaggaccagagaattcgaatacaacgactcannnctagcgttac

SEQ ID NO: 7086 - DNA, 46 bp, Artificial Sequence
  Synthesized adaptor oligonucleotide
  misc_feature (34)..(36): n is a, c, g, or t
tgcaggaccagagaattcgaatacaacaacttannnctagcgttac

SEQ ID NO: 7087 - DNA, 46 bp, Artificial Sequence
  Synthesized adaptor oligonucleotide
  misc_feature (34)..(36): n is a, c, g, or t
tgcaggaccagagaattcgaatacatctggtagnnnctagcgttac

SEQ ID NO: 7088 - DNA, 46 bp, Artificial Sequence
  Synthesized adaptor oligonucleotide
  misc_feature (34)..(36): n is a, c, g, or t
tgcaggaccagagaattcgaatacactatggcannnctagcgttac

SEQ ID NO: 7089 - DNA, 46 bp, Artificial Sequence
  Synthesized adaptor oligonucleotide
  misc_feature (34)..(36): n is a, c, g, or t
tgcaggaccagagaattcgaatacaacccgcgannngatcgacatg

SEQ ID NO: 7090 - DNA, 46 bp, Artificial Sequence
  Synthesized adaptor oligonucleotide
  misc_feature (34)..(36): n is a, c, g, or t
tgcaggaccagagaattcgaatacacgcggtacnnngatcgacatg

SEQ ID NO: 7091 - DNA, 46 bp, Artificial Sequence
  Synthesized adaptor oligonucleotide
  misc_feature (34)..(36): n is a, c, g, or t
tgcaggaccagagaattcgaatacacacatcagnnngatcgacatg

SEQ ID NO: 7092 - DNA, 46 bp, Artificial Sequence
  Synthesized adaptor oligonucleotide
  misc_feature (34)..(36): n is a, c, g, or t
tgcaggaccagagaattcgaatacatagacaccnnngatcgacatg

SEQ ID NO: 7093 - DNA, 46 bp, Artificial Sequence
  Synthesized adaptor oligonucleotide
  misc_feature (34)..(36): n is a, c, g, or t
tgcaggaccagagaattcgaatacaatgtaaagnnngatcgacatg

SEQ ID NO: 7094 - DNA, 46 bp, Artificial Sequence
  Synthesized adaptor oligonucleotide
  misc_feature (34)..(36): n is a, c, g, or t
tgcaggaccagagaattcgaatacaatcctctgnnngatcgacatg

SEQ ID NO: 7095 - DNA, 46 bp, Artificial Sequence
  Synthesized adaptor oligonucleotide
  misc_feature (34)..(36): n is a, c, g, or t
tgcaggaccagagaattcgaatacagtcgtcccnnngatcgacatg

SEQ ID NO: 7096 - DNA, 46 bp, Artificial Sequence
  Synthesized adaptor oligonucleotide
  misc_feature (34)..(36): n is a, c, g, or t
tgcaggaccagagaattcgaatacaacttgcagnnngatcgacatg

SEQ ID NO: 7097 - DNA, 46 bp, Artificial Sequence
  Synthesized adaptor oligonucleotide
  misc_feature (34)..(36): n is a, c, g, or t
tgcaggaccagagaattcgaatacagagcgctcnnngatcgacatg

SEQ ID NO: 7098 - DNA, 46 bp, Artificial Sequence
  Synthesized adaptor oligonucleotide
  misc_feature (34)..(36): n is a, c, g, or t
tgcaggaccagagaattcgaatacatcgccaggnnngatcgacatg

SEQ ID NO: 7099 - DNA, 46 bp, Artificial Sequence
  Synthesized adaptor oligonucleotide
  misc_feature (34)..(36): n is a, c, g, or t
tgcaggaccagagaattcgaatacacgatgccgnnngatcgacatg

SEQ ID NO: 7100 - DNA, 46 bp, Artificial Sequence
  Synthesized adaptor oligonucleotide
  misc_feature (34)..(36): n is a, c, g, or t
tgcaggaccagagaattcgaatacaacccccacnnngatcgacatg

SEQ ID NO: 7101 - DNA, 46 bp, Artificial Sequence
  Synthesized adaptor oligonucleotide
  misc_feature (34)..(36): n is a, c, g, or t
tgcaggaccagagaattcgaatacatcatttcannngatcgacatg

SEQ ID NO: 7102 - DNA, 46 bp, Artificial Sequence
  Synthesized adaptor oligonucleotide
  misc_feature (34)..(36): n is a, c, g, or t
tgcaggaccagagaattcgaatacatgccggtgnnngatcgacatg

SEQ ID NO: 7103 - DNA, 46 bp, Artificial Sequence
  Synthesized adaptor oligonucleotide
  misc_feature (34)..(36): n is a, c, g, or t
tgcaggaccagagaattcgaatacacgcaagaannngatcgacatg

SEQ ID NO: 7104 - DNA, 46 bp, Artificial Sequence
  Synthesized adaptor oligonucleotide
  misc_feature (34)..(36): n is a, c, g, or t
tgcaggaccagagaattcgaatacatagaccacnnngatcgacatg

SEQ ID NO: 7105 - DNA, 46 bp, Artificial Sequence
  Synthesized adaptor oligonucleotide
  misc_feature (34)..(36): n is a, c, g, or t
tgcaggaccagagaattcgaatacaaccgaagannngatcgacatg

SEQ ID NO: 7106 - DNA, 46 bp, Artificial Sequence
  Synthesized adaptor oligonucleotide
  misc_feature (34)..(36): n is a, c, g, or t
tgcaggaccagagaattcgaatacatcttgttannngatcgacatg

SEQ ID NO: 7107 - DNA, 46 bp, Artificial Sequence
  Synthesized adaptor oligonucleotide
  misc_feature (34)..(36): n is a, c, g, or t
tgcaggaccagagaattcgaatacacagactgtnnngatcgacatg

SEQ ID NO: 7108 - DNA, 46 bp, Artificial Sequence
  Synthesized adaptor oligonucleotide
  misc_feature (34)..(36): n is a, c, g, or t
tgcaggaccagagaattcgaatacagatctgcannngatcgacatg

SEQ ID NO: 7109 - DNA, 46 bp, Artificial Sequence
  Synthesized adaptor oligonucleotide
  misc_feature (34)..(36): n is a, c, g, or t
tgcaggaccagagaattcgaatacatcgaaggannngatcgacatg

SEQ ID NO: 7110 - DNA, 46 bp, Artificial Sequence
  Synthesized adaptor oligonucleotide
  misc_feature (34)..(36): n is a, c, g, or t
tgcaggaccagagaattcgaatacacggagcagnnngatcgacatg

SEQ ID NO: 7111 - DNA, 46 bp, Artificial Sequence
  Synthesized adaptor oligonucleotide
  misc_feature (34)..(36): n is a, c, g, or t
tgcaggaccagagaattcgaatacacaccggacnnngatcgacatg

SEQ ID NO: 7112 - DNA, 46 bp, Artificial Sequence
  Synthesized adaptor oligonucleotide
  misc_feature (34)..(36): n is a, c, g, or t
tgcaggaccagagaattcgaatacaataacgttnnngatcgacatg

SEQ ID NO: 7113 - DNA, 46 bp, Artificial Sequence
  Synthesized adaptor oligonucleotide
  misc_feature (34)..(36): n is a, c, g, or t
tgcaggaccagagaattcgaatacatgtctggannngatcgacatg

SEQ ID NO: 7114 - DNA, 46 bp, Artificial Sequence
  Synthesized adaptor oligonucleotide
  misc_feature (34)..(36): n is a, c, g, or t
tgcaggaccagagaattcgaatacatatggaccnnngatcgacatg

SEQ ID NO: 7115 - DNA, 46 bp, Artificial Sequence
  Synthesized adaptor oligonucleotide
  misc_feature (34)..(36): n is a, c, g, or t
tgcaggaccagagaattcgaatacacaacttggnnngatcgacatg

SEQ ID NO: 7116 - DNA, 46 bp, Artificial Sequence
  Synthesized adaptor oligonucleotide
  misc_feature (34)..(36): n is a, c, g, or t
tgcaggaccagagaattcgaatacacaatcgacnnngatcgacatg

SEQ ID NO: 7117 - DNA, 46 bp, Artificial Sequence
  Synthesized adaptor oligonucleotide
  misc_feature (34)..(36): n is a, c, g, or t
tgcaggaccagagaattcgaatacagcaaggcgnnngatcgacatg

SEQ ID NO: 7118 - DNA, 46 bp, Artificial Sequence
  Synthesized adaptor oligonucleotide
  misc_feature (34)..(36): n is a, c, g, or t
tgcaggaccagagaattcgaatacagccaacgcnnngatcgacatg

SEQ ID NO: 7119 - DNA, 46 bp, Artificial Sequence
  Synthesized adaptor oligonucleotide
  misc_feature (34)..(36): n is a, c, g, or t
tgcaggaccagagaattcgaatacatcgttaaannngatcgacatg

SEQ ID NO: 7120 - DNA, 46 bp, Artificial Sequence
  Synthesized adaptor oligonucleotide
  misc_feature (34)..(36): n is a, c, g, or t
tgcaggaccagagaattcgaatacactagcgtannngatcgacatg

SEQ ID NO: 7121 - DNA, 46 bp, Artificial Sequence
  Synthesized adaptor oligonucleotide
  misc_feature (34)..(36): n is a, c, g, or t
tgcaggaccagagaattcgaatacactgagttgnnngatcgacatg

SEQ ID NO: 7122 - DNA, 46 bp, Artificial Sequence
  Synthesized adaptor oligonucleotide
  misc_feature (34)..(36): n is a, c, g, or t
tgcaggaccagagaattcgaatacatggcgcgtnnngatcgacatg

SEQ ID NO: 7123 - DNA, 46 bp, Artificial Sequence
  Synthesized adaptor oligonucleotide
  misc_feature (34)..(36): n is a, c, g, or t
tgcaggaccagagaattcgaatacagtgacttgnnngatcgacatg

SEQ ID NO: 7124 - DNA, 46 bp, Artificial Sequence
  Synthesized adaptor oligonucleotide
  misc_feature (34)..(36): n is a, c, g, or t
tgcaggaccagagaattcgaatacactgcgaatnnngatcgacatg

SEQ ID NO: 7125 - DNA, 46 bp, Artificial Sequence
  Synthesized adaptor oligonucleotide
  misc_feature (34)..(36): n is a, c, g, or t
tgcaggaccagagaattcgaatacacatgacacnnngatcgacatg

SEQ ID NO: 7126 - DNA, 46 bp, Artificial Sequence
  Synthesized adaptor oligonucleotide
  misc_feature (34)..(36): n is a, c, g, or t
tgcaggaccagagaattcgaatacagcgatttgnnngatcgacatg

SEQ ID NO: 7127 - DNA, 46 bp, Artificial Sequence
  Synthesized adaptor oligonucleotide
  misc_feature (34)..(36): n is a, c, g, or t
tgcaggaccagagaattcgaatacaactaggagnnngatcgacatg

SEQ ID NO: 7128 - DNA, 46 bp, Artificial Sequence
  Synthesized adaptor oligonucleotide
  misc_feature (34)..(36): n is a, c, g, or t
tgcaggaccagagaattcgaatacagcgcagctnnngatcgacatg

SEQ ID NO: 7129 - DNA, 46 bp, Artificial Sequence
  Synthesized adaptor oligonucleotide
  misc_feature (34)..(36): n is a, c, g, or t
tgcaggaccagagaattcgaatacacacagccgnnngatcgacatg

SEQ ID NO: 7130 - DNA, 46 bp, Artificial Sequence
  Synthesized adaptor oligonucleotide
  misc_feature (34)..(36): n is a, c, g, or t
tgcaggaccagagaattcgaatacagccttgttnnngatcgacatg

SEQ ID NO: 7131 - DNA, 46 bp, Artificial Sequence
  Synthesized adaptor oligonucleotide
  misc_feature (34)..(36): n is a, c, g, or t
tgcaggaccagagaattcgaatacaaatatcgtnnngatcgacatg

SEQ ID NO: 7132 - DNA, 46 bp, Artificial Sequence
  Synthesized adaptor oligonucleotide
  misc_feature (34)..(36): n is a, c, g, or t
tgcaggaccagagaattcgaatacaccgaaagannngatcgacatg

SEQ ID NO: 7133 - DNA, 46 bp, Artificial Sequence
  Synthesized adaptor oligonucleotide
  misc_feature (34)..(36): n is a, c, g, or t
tgcaggaccagagaattcgaatacacaaaggtgnnngatcgacatg

SEQ ID NO: 7134 - DNA, 46 bp, Artificial Sequence
  Synthesized adaptor oligonucleotide
  misc_feature (34)..(36): n is a, c, g, or t
tgcaggaccagagaattcgaatacaaaatccatnnngatcgacatg

SEQ ID NO: 7135 - DNA, 46 bp, Artificial Sequence
  Synthesized adaptor oligonucleotide
  misc_feature (34)..(36): n is a, c, g, or t
tgcaggaccagagaattcgaatacaaacaatctnnngatcgacatg

SEQ ID NO: 7136 - DNA, 46 bp, Artificial Sequence
  Synthesized adaptor oligonucleotide
  misc_feature (34)..(36): n is a, c, g, or t
tgcaggaccagagaattcgaatacacattggcannngatcgacatg

SEQ ID NO: 7137 - DNA, 46 bp, Artificial Sequence
  Synthesized adaptor oligonucleotide
  misc_feature (34)..(36): n is a, c, g, or t
tgcaggaccagagaattcgaatacactacaacgnnngatcgacatg

SEQ ID NO: 7138 - DNA, 46 bp, Artificial Sequence
  Synthesized adaptor oligonucleotide
  misc_feature (34)..(36): n is a, c, g, or t
tgcaggaccagagaattcgaatacaatcgagagnnngatcgacatg

SEQ ID NO: 7139 - DNA, 46 bp, Artificial Sequence
  Synthesized adaptor oligonucleotide
  misc_feature (34)..(36): n is a, c, g, or t
tgcaggaccagagaattcgaatacacgcgtcctnnngatcgacatg

SEQ ID NO: 7140 - DNA, 46 bp, Artificial Sequence
  Synthesized adaptor oligonucleotide
  misc_feature (34)..(36): n is a, c, g, or t
tgcaggaccagagaattcgaatacattacgtttnnngatcgacatg

SEQ ID NO: 7141 - DNA, 46 bp, Artificial Sequence
  Synthesized adaptor oligonucleotide
  misc_feature (34)..(36): n is a, c, g, or t
tgcaggaccagagaattcgaatacagtagtcgtnnngatcgacatg

SEQ ID NO: 7142 - DNA, 46 bp, Artificial Sequence
  Synthesized adaptor oligonucleotide
  misc_feature (34)..(36): n is a, c, g, or t
tgcaggaccagagaattcgaatacatgcctcgcnnngatcgacatg

SEQ ID NO: 7143 - DNA, 46 bp, Artificial Sequence
  Synthesized adaptor oligonucleotide
  misc_feature (34)..(36): n is a, c, g, or t
tgcaggaccagagaattcgaatacaatacattgnnngatcgacatg

SEQ ID NO: 7144 - DNA, 46 bp, Artificial Sequence
  Synthesized adaptor oligonucleotide
  misc_feature (34)..(36): n is a, c, g, or t
tgcaggaccagagaattcgaatacatataaaaannngatcgacatg

SEQ ID NO: 7145 - DNA, 46 bp, Artificial Sequence
  Synthesized adaptor oligonucleotide
  misc_feature (34)..(36): n is a, c, g, or t
tgcaggaccagagaattcgaatacatacctgctnnngatcgacatg

SEQ ID NO: 7146 - DNA, 46 bp, Artificial Sequence
  Synthesized adaptor oligonucleotide
  misc_feature (34)..(36): n is a, c, g, or t
tgcaggaccagagaattcgaatacatgagaacgnnngatcgacatg

SEQ ID NO: 7147 - DNA, 46 bp, Artificial Sequence
  Synthesized adaptor oligonucleotide
  misc_feature (34)..(36): n is a, c, g, or t
tgcaggaccagagaattcgaatacaggaactgannngatcgacatg

SEQ ID NO: 7148 - DNA, 46 bp, Artificial Sequence
  Synthesized adaptor oligonucleotide
  misc_feature (34)..(36): n is a, c, g, or t
tgcaggaccagagaattcgaatacaagagcgcgnnngatcgacatg

SEQ ID NO: 7149 - DNA, 46 bp, Artificial Sequence
  Synthesized adaptor oligonucleotide
  misc_feature (34)..(36): n is a, c, g, or t
tgcaggaccagagaattcgaatacaacgccacgnnntgcatcaggt

SEQ ID NO: 7150 - DNA, 46 bp, Artificial Sequence
  Synthesized adaptor oligonucleotide
  misc_feature (34)..(36): n is a, c, g, or t
tgcaggaccagagaattcgaatacatcccctaannntgcatcaggt

SEQ ID NO: 7151 - DNA, 46 bp, Artificial Sequence
  Synthesized adaptor oligonucleotide
  misc_feature (34)..(36): n is a, c, g, or t
tgcaggaccagagaattcgaatacatcggcatannntgcatcaggt

SEQ ID NO: 7152 - DNA, 46 bp, Artificial Sequence
  Synthesized adaptor oligonucleotide
  misc_feature (34)..(36): n is a, c, g, or t
tgcaggaccagagaattcgaatacacgcctccannntgcatcaggt

SEQ ID NO: 7153 - DNA, 46 bp, Artificial Sequence
  Synthesized adaptor oligonucleotide
  misc_feature (34)..(36): n is a, c, g, or t
tgcaggaccagagaattcgaatacaaggtggcgnnntgcatcaggt

SEQ ID NO: 7154 - DNA, 46 bp, Artificial Sequence
  Synthesized adaptor oligonucleotide
  misc_feature (34)..(36): n is a, c, g, or t
tgcaggaccagagaattcgaatacaaaggttccnnntgcatcaggt

SEQ ID NO: 7155 - DNA, 46 bp, Artificial Sequence
  Synthesized adaptor oligonucleotide
  misc_feature (34)..(36): n is a, c, g, or t
tgcaggaccagagaattcgaatacacggaaggcnnntgcatcaggt

SEQ ID NO: 7156 - DNA, 46 bp, Artificial Sequence
  Synthesized adaptor oligonucleotide
  misc_feature (34)..(36): n is a, c, g, or t
tgcaggaccagagaattcgaatacaaggcattcnnntgcatcaggt

SEQ ID NO: 7157 - DNA, 46 bp, Artificial Sequence
  Synthesized adaptor oligonucleotide
  misc_feature (34)..(36): n is a, c, g, or t
tgcaggaccagagaattcgaatacacaccagcgnnntgcatcaggt

SEQ ID NO: 7158 - DNA, 46 bp, Artificial Sequence
  Synthesized adaptor oligonucleotide
  misc_feature (34)..(36): n is a, c, g, or t
tgcaggaccagagaattcgaatacatatgcgtgnnntgcatcaggt

SEQ ID NO: 7159 - DNA, 46 bp, Artificial Sequence
  Synthesized adaptor oligonucleotide
  misc_feature (34)..(36): n is a, c, g, or t
tgcaggaccagagaattcgaatacagcatagctnnntgcatcaggt

SEQ ID NO: 7160 - DNA, 46 bp, Artificial Sequence
  Synthesized adaptor oligonucleotide
  misc_feature (34)..(36): n is a, c, g, or t
tgcaggaccagagaattcgaatacatcactaggnnntgcatcaggt

SEQ ID NO: 7161 - DNA, 46 bp, Artificial Sequence
  Synthesized adaptor oligonucleotide
  misc_feature (34)..(36): n is a, c, g, or t
tgcaggaccagagaattcgaatacagccgagctnnntgcatcaggt

SEQ ID NO: 7162 - DNA, 46 bp, Artificial Sequence
  Synthesized adaptor oligonucleotide
  misc_feature (34)..(36): n is a, c, g, or t
tgcaggaccagagaattcgaatacaactgccaannntgcatcaggt

SEQ ID NO: 7163 - DNA, 46 bp, Artificial Sequence
  Synthesized adaptor oligonucleotide
  misc_feature (34)..(36): n is a, c, g, or t
tgcaggaccagagaattcgaatacaccgacaatnnntgcatcaggt

SEQ ID NO: 7164 - DNA, 46 bp, Artificial Sequence
  Synthesized adaptor oligonucleotide
  misc_feature (34)..(36): n is a, c, g, or t
tgcaggaccagagaattcgaatacacaggcccannntgcatcaggt

SEQ ID NO: 7165 - DNA, 46 bp, Artificial Sequence
  Synthesized adaptor oligonucleotide
  misc_feature (34)..(36): n is a, c, g, or t
tgcaggaccagagaattcgaatacacaacccccnnntgcatcaggt

SEQ ID NO: 7166 - DNA, 46 bp, Artificial Sequence
  Synthesized adaptor oligonucleotide
  misc_feature (34)..(36): n is a, c, g, or t
tgcaggaccagagaattcgaatacaaagacgacnnntgcatcaggt

SEQ ID NO: 7167 - DNA, 46 bp, Artificial Sequence
  Synthesized adaptor oligonucleotide
  misc_feature (34)..(36): n is a, c, g, or t
tgcaggaccagagaattcgaatacatacaagaannntgcatcaggt

SEQ ID NO: 7168 - DNA, 46 bp, Artificial Sequence
  Synthesized adaptor oligonucleotide
  misc_feature (34)..(36): n is a, c, g, or t
tgcaggaccagagaattcgaatacaataggcctnnntgcatcaggt

SEQ ID NO: 7169 - DNA, 46 bp, Artificial Sequence
  Synthesized adaptor oligonucleotide
  misc_feature (34)..(36): n is a, c, g, or t
tgcaggaccagagaattcgaatacattggatatnnntgcatcaggt

SEQ ID NO: 7170 - DNA, 46 bp, Artificial Sequence
  Synthesized adaptor oligonucleotide
  misc_feature (34)..(36): n is a, c, g, or t
tgcaggaccagagaattcgaatacactatcgctnnntgcatcaggt

SEQ ID NO: 7171 - DNA, 46 bp, Artificial Sequence
  Synthesized adaptor oligonucleotide
  misc_feature (34)..(36): n is a, c, g, or t
tgcaggaccagagaattcgaatacactcttgacnnntgcatcaggt

SEQ ID NO: 7172 - DNA, 46 bp, Artificial Sequence
  Synthesized adaptor oligonucleotide
  misc_feature (34)..(36): n is a, c, g, or t
tgcaggaccagagaattcgaatacaaattaggannntgcatcaggt

SEQ ID NO: 7173 - DNA, 46 bp, Artificial Sequence
  Synthesized adaptor oligonucleotide
  misc_feature (34)..(36): n is a, c, g, or t
tgcaggaccagagaattcgaatacacgttgcttnnntgcatcaggt

SEQ ID NO: 7174 - DNA, 46 bp, Artificial Sequence
  Synthesized adaptor oligonucleotide
  misc_feature (34)..(36): n is a, c, g, or t
tgcaggaccagagaattcgaatacatttcccctnnntgcatcaggt

SEQ ID NO: 7175 - DNA, 46 bp, Artificial Sequence
  Synthesized adaptor oligonucleotide
  misc_feature (34)..(36): n is a, c, g, or t
tgcaggaccagagaattcgaatacaactacctcnnntgcatcaggt

SEQ ID NO: 7176 - DNA, 46 bp, Artificial Sequence
  Synthesized adaptor oligonucleotide
  misc_feature (34)..(36): n is a, c, g, or t
tgcaggaccagagaattcgaatacaactctgctnnntgcatcaggt

SEQ ID NO: 7177 - DNA, 46 bp, Artificial Sequence
  Synthesized adaptor oligonucleotide
  misc_feature (34)..(36): n is a, c, g, or t
tgcaggaccagagaattcgaatacactacctcannntgcatcaggt

SEQ ID NO: 7178 - DNA, 46 bp, Artificial Sequence
  Synthesized adaptor oligonucleotide
  misc_feature (34)..(36): n is a, c, g, or t
tgcaggaccagagaattcgaatacaactgctagnnntgcatcaggt

SEQ ID NO: 7179 - DNA, 46 bp, Artificial Sequence
  Synthesized adaptor oligonucleotide
  misc_feature (34)..(36): n is a, c, g, or t
tgcaggaccagagaattcgaatacacgcgcagtnnntgcatcaggt

SEQ ID NO: 7180 - DNA, 46 bp, Artificial Sequence
  Synthesized adaptor oligonucleotide
  misc_feature (34)..(36): n is a, c, g, or t
tgcaggaccagagaattcgaatacaggctttctnnntgcatcaggt

SEQ ID NO: 7181 - DNA, 46 bp, Artificial Sequence
  Synthesized adaptor oligonucleotide
  misc_feature (34)..(36): n is a, c, g, or t
tgcaggaccagagaattcgaatacactggactannntgcatcaggt

SEQ ID NO: 7182 - DNA, 46 bp, Artificial Sequence
  Synthesized adaptor oligonucleotide
  misc_feature (34)..(36): n is a, c, g, or t
tgcaggaccagagaattcgaatacaacatcagcnnntgcatcaggt

SEQ ID NO: 7183 - DNA, 46 bp, Artificial Sequence
  Synthesized adaptor oligonucleotide
  misc_feature (34)..(36): n is a, c, g, or t
tgcaggaccagagaattcgaatacatcagttccnnntgcatcaggt

SEQ ID NO: 7184 - DNA, 46 bp, Artificial Sequence
  Synthesized adaptor oligonucleotide
  misc_feature (34)..(36): n is a, c, g, or t
tgcaggaccagagaattcgaatacatcacgatgnnntgcatcaggt

SEQ ID NO: 7185 - DNA, 46 bp, Artificial Sequence
  Synthesized adaptor oligonucleotide
  misc_feature (34)..(36): n is a, c, g, or t
tgcaggaccagagaattcgaatacagtatgcacnnntgcatcaggt

SEQ ID NO: 7186 - DNA, 46 bp, Artificial Sequence
  Synthesized adaptor oligonucleotide
  misc_feature (34)..(36): n is a, c, g, or t
tgcaggaccagagaattcgaatacatcaggcgcnnntgcatcaggt

SEQ ID NO: 7187 - DNA, 46 bp, Artificial Sequence
  Synthesized adaptor oligonucleotide
  misc_feature (34)..(36): n is a, c, g, or t
tgcaggaccagagaattcgaatacagttttccgnnntgcatcaggt

SEQ ID NO: 7188 - DNA, 46 bp, Artificial Sequence
  Synthesized adaptor oligonucleotide
  misc_feature (34)..(36): n is a, c, g, or t
tgcaggaccagagaattcgaatacaggtcggagnnntgcatcaggt

SEQ ID NO: 7189 - DNA, 46 bp, Artificial Sequence
  Synthesized adaptor oligonucleotide
  misc_feature (34)..(36): n is a, c, g, or t
tgcaggaccagagaattcgaatacaataaggcgnnntgcatcaggt

SEQ ID NO: 7190 - DNA, 46 bp, Artificial Sequence
  Synthesized adaptor oligonucleotide
  misc_feature (34)..(36): n is a, c, g, or t
tgcaggaccagagaattcgaatacaagccgaccnnntgcatcaggt

SEQ ID NO: 7191 - DNA, 46 bp, Artificial Sequence
  Synthesized adaptor oligonucleotide
  misc_feature (34)..(36): n is a, c, g, or t
tgcaggaccagagaattcgaatacacatgtcagnnntgcatcaggt

SEQ ID NO: 7192 - DNA, 46 bp, Artificial Sequence
  Synthesized adaptor oligonucleotide
  misc_feature (34)..(36): n is a, c, g, or t
tgcaggaccagagaattcgaatacattttagctnnntgcatcaggt

SEQ ID NO: 7193 - DNA, 46 bp, Artificial Sequence
  Synthesized adaptor oligonucleotide
  misc_feature (34)..(36): n is a, c, g, or t
tgcaggaccagagaattcgaatacatcgagttgnnntgcatcaggt

SEQ ID NO: 7194 - DNA, 46 bp, Artificial Sequence
  Synthesized adaptor oligonucleotide
  misc_feature (34)..(36): n is a, c, g, or t
tgcaggaccagagaattcgaatacagccacctcnnntgcatcaggt

SEQ ID NO: 7195 - DNA, 46 bp, Artificial Sequence
  Synthesized adaptor oligonucleotide
  misc_feature (34)..(36): n is a, c, g, or t
tgcaggaccagagaattcgaatacatgttgtggnnntgcatcaggt

SEQ ID NO: 7196 - DNA, 46 bp, Artificial Sequence
  Synthesized adaptor oligonucleotide
  misc_feature (34)..(36): n is a, c, g, or t
tgcaggaccagagaattcgaatacagttgtgtgnnntgcatcaggt

SEQ ID NO: 7197 - DNA, 46 bp, Artificial Sequence
  Synthesized adaptor oligonucleotide
  misc_feature (34)..(36): n is a, c, g, or t
tgcaggaccagagaattcgaatacacgtgaactnnntgcatcaggt

SEQ ID NO: 7198 - DNA, 46 bp, Artificial Sequence
  Synthesized adaptor oligonucleotide
  misc_feature (34)..(36): n is a, c, g, or t
tgcaggaccagagaattcgaatacaaaggctctnnntgcatcaggt

SEQ ID NO: 7199 - DNA, 46 bp, Artificial Sequence
  Synthesized adaptor oligonucleotide
  misc_feature (34)..(36): n is a, c, g, or t
tgcaggaccagagaattcgaatacatattcttgnnntgcatcaggt

SEQ ID NO: 7200 - DNA, 46 bp, Artificial Sequence
  Synthesized adaptor oligonucleotide
  misc_feature (34)..(36): n is a, c, g, or t
tgcaggaccagagaattcgaatacacattacttnnntgcatcaggt

SEQ ID NO: 7201 - DNA, 46 bp, Artificial Sequence
  Synthesized adaptor oligonucleotide
  misc_feature (34)..(36): n is a, c, g, or t
tgcaggaccagagaattcgaatacaccaagactnnntgcatcaggt

SEQ ID NO: 7202 - DNA, 46 bp, Artificial Sequence
  Synthesized adaptor oligonucleotide
  misc_feature (34)..(36): n is a, c, g, or t
tgcaggaccagagaattcgaatacaagttccagnnntgcatcaggt

SEQ ID NO: 7203 - DNA, 46 bp, Artificial Sequence
  Synthesized adaptor oligonucleotide
  misc_feature (34)..(36): n is a, c, g, or t
tgcaggaccagagaattcgaatacaaaccagtcnnntgcatcaggt

SEQ ID NO: 7204 - DNA, 46 bp, Artificial Sequence
  Synthesized adaptor oligonucleotide
  misc_feature (34)..(36): n is a, c, g, or t
tgcaggaccagagaattcgaatacatggctcaannntgcatcaggt

SEQ ID NO: 7205 - DNA, 46 bp, Artificial Sequence
  Synthesized adaptor oligonucleotide
  misc_feature (34)..(36): n is a, c, g, or t
tgcaggaccagagaattcgaatacatctttatgnnntgcatcaggt

SEQ ID NO: 7206 - DNA, 46 bp, Artificial Sequence
  Synthesized adaptor oligonucleotide
  misc_feature (34)..(36): n is a, c, g, or t
tgcaggaccagagaattcgaatacaggtgacttnnntgcatcaggt

SEQ ID NO: 7207 - DNA, 46 bp, Artificial Sequence
  Synthesized adaptor oligonucleotide
  misc_feature (34)..(36): n is a, c, g, or t
tgcaggaccagagaattcgaatacatcctaaccnnntgcatcaggt

SEQ ID NO: 7208 - DNA, 46 bp, Artificial Sequence
  Synthesized adaptor oligonucleotide
  misc_feature (34)..(36): n is a, c, g, or t
tgcaggaccagagaattcgaatacagcgtaaagnnntgcatcaggt

SEQ ID NO: 7209 - DNA, 46 bp, Artificial Sequence
  Synthesized adaptor oligonucleotide
  misc_feature (34)..(36): n is a, c, g, or t
tgcaggaccagagaattcgaatacatggtccaannnacgtatgcca

SEQ ID NO: 7210 - DNA, 46 bp, Artificial Sequence
  Synthesized adaptor oligonucleotide
  misc_feature (34)..(36): n is a, c, g, or t
tgcaggaccagagaattcgaatacagtactcagnnnacgtatgcca

SEQ ID NO: 7211 - DNA, 46 bp, Artificial Sequence
  Synthesized adaptor oligonucleotide
  misc_feature (34)..(36): n is a, c, g, or t
tgcaggaccagagaattcgaatacagaagccccnnnacgtatgcca

SEQ ID NO: 7212 - DNA, 46 bp, Artificial Sequence
  Synthesized adaptor oligonucleotide
  misc_feature (34)..(36): n is a, c, g, or t
tgcaggaccagagaattcgaatacattaaccggnnnacgtatgcca

SEQ ID NO: 7213 - DNA, 46 bp, Artificial Sequence
  Synthesized adaptor oligonucleotide
  misc_feature (34)..(36): n is a, c, g, or t
tgcaggaccagagaattcgaatacataacctggnnnacgtatgcca

SEQ ID NO: 7214 - DNA, 46 bp, Artificial Sequence
  Synthesized adaptor oligonucleotide
  misc_feature (34)..(36): n is a, c, g, or t
tgcaggaccagagaattcgaatacagtcgactannnacgtatgcca

SEQ ID NO: 7215 - DNA, 46 bp, Artificial Sequence
  Synthesized adaptor oligonucleotide
  misc_feature (34)..(36): n is a, c, g, or t
tgcaggaccagagaattcgaatacaccaaacgtnnnacgtatgcca

SEQ ID NO: 7216 - DNA, 46 bp, Artificial Sequence
  Synthesized adaptor oligonucleotide
  misc_feature (34)..(36): n is a, c, g, or t
tgcaggaccagagaattcgaatacaacgtatcgnnnacgtatgcca

SEQ ID NO: 7217 - DNA, 46 bp, Artificial Sequence
  Synthesized adaptor oligonucleotide
  misc_feature (34)..(36): n is a, c, g, or t
tgcaggaccagagaattcgaatacacacggccannnacgtatgcca

SEQ ID NO: 7218 - DNA, 46 bp, Artificial Sequence
  Synthesized adaptor oligonucleotide
  misc_feature (34)..(36): n is a, c, g, or t
tgcaggaccagagaattcgaatacaaggtttgcnnnacgtatgcca

SEQ ID NO: 7219 - DNA, 46 bp, Artificial Sequence
  Synthesized adaptor oligonucleotide
  misc_feature (34)..(36): n is a, c, g, or t
tgcaggaccagagaattcgaatacacgacgcgtnnnacgtatgcca

SEQ ID NO: 7220 - DNA, 46 bp, Artificial Sequence
  Synthesized adaptor oligonucleotide
  misc_feature (34)..(36): n is a, c, g, or t
tgcaggaccagagaattcgaatacaccgacgtgnnnacgtatgcca

SEQ ID NO: 7221 - DNA, 46 bp, Artificial Sequence
  Synthesized adaptor oligonucleotide
  misc_feature (34)..(36): n is a, c, g, or t
tgcaggaccagagaattcgaatacacagtttttnnnacgtatgcca

SEQ ID NO: 7222 - DNA, 46 bp, Artificial Sequence
  Synthesized adaptor oligonucleotide
  misc_feature (34)..(36): n is a, c, g, or t
tgcaggaccagagaattcgaatacatgcccggannnacgtatgcca

SEQ ID NO: 7223 - DNA, 46 bp, Artificial Sequence
  Synthesized adaptor oligonucleotide
  misc_feature (34)..(36): n is a, c, g, or t
tgcaggaccagagaattcgaatacagccactccnnnacgtatgcca

SEQ ID NO: 7224 - DNA, 46 bp, Artificial Sequence
  Synthesized adaptor oligonucleotide
  misc_feature (34)..(36): n is a, c, g, or t
tgcaggaccagagaattcgaatacagacgaagtnnnacgtatgcca

SEQ ID NO: 7225 - DNA, 46 bp, Artificial Sequence
  Synthesized adaptor oligonucleotide
  misc_feature (34)..(36): n is a, c, g, or t
tgcaggaccagagaattcgaatacaggttccttnnnacgtatgcca

SEQ ID NO: 7226 - DNA, 46 bp, Artificial Sequence
  Synthesized adaptor oligonucleotide
  misc_feature (34)..(36): n is a, c, g, or t
tgcaggaccagagaattcgaatacaccggaattnnnacgtatgcca

SEQ ID NO: 7227 - DNA, 46 bp, Artificial Sequence
  Synthesized adaptor oligonucleotide
  misc_feature (34)..(36): n is a, c, g, or t
tgcaggaccagagaattcgaatacatcggcagcnnnacgtatgcca

SEQ ID NO: 7228 - DNA, 46 bp, Artificial Sequence
  Synthesized adaptor oligonucleotide
  misc_feature (34)..(36): n is a, c, g, or t
tgcaggaccagagaattcgaatacagctagagannnacgtatgcca

SEQ ID NO: 7229 - DNA, 46 bp, Artificial Sequence
  Synthesized adaptor oligonucleotide
  misc_feature (34)..(36): n is a, c, g, or t
tgcaggaccagagaattcgaatacaccacttacnnnacgtatgcca

SEQ ID NO: 7230 - DNA, 46 bp, Artificial Sequence
  Synthesized adaptor oligonucleotide
  misc_feature (34)..(36): n is a, c, g, or t
tgcaggaccagagaattcgaatacaaccaccggnnnacgtatgcca

SEQ ID NO: 7231 - DNA, 46 bp, Artificial Sequence
  Synthesized adaptor oligonucleotide
  misc_feature (34)..(36): n is a, c, g, or t
tgcaggaccagagaattcgaatacagaaacatannnacgtatgcca

SEQ ID NO: 7232 - DNA, 46 bp, Artificial Sequence
  Synthesized adaptor oligonucleotide
  misc_feature (34)..(36): n is a, c, g, or t
tgcaggaccagagaattcgaatacagctgaaagnnnacgtatgcca

SEQ ID NO: 7233 - DNA, 46 bp, Artificial Sequence
  Synthesized adaptor oligonucleotide
  misc_feature (34)..(36): n is a, c, g, or t
tgcaggaccagagaattcgaatacataagaagtnnnacgtatgcca

SEQ ID NO: 7234 - DNA, 46 bp, Artificial Sequence
  Synthesized adaptor oligonucleotide
  misc_feature (34)..(36): n is a, c, g, or t
tgcaggaccagagaattcgaatacacgtgactannnacgtatgcca

SEQ ID NO: 7235 - DNA, 46 bp, Artificial Sequence
  Synthesized adaptor oligonucleotide
  misc_feature (34)..(36): n is a, c, g, or t
tgcaggaccagagaattcgaatacattaagatcnnnacgtatgcca

SEQ ID NO: 7236 - DNA, 46 bp, Artificial Sequence
  Synthesized adaptor oligonucleotide
  misc_feature (34)..(36): n is a, c, g, or t
tgcaggaccagagaattcgaatacatggatcacnnnacgtatgcca

SEQ ID NO: 7237 - DNA, 46 bp, Artificial Sequence
  Synthesized adaptor oligonucleotide
  misc_feature (34)..(36): n is a, c, g, or t
tgcaggaccagagaattcgaatacaccgagctgnnnacgtatgcca

SEQ ID NO: 7238 - DNA, 46 bp, Artificial Sequence
  Synthesized adaptor oligonucleotide
  misc_feature (34)..(36): n is a, c, g, or t
tgcaggaccagagaattcgaatacactcataaannnacgtatgcca

SEQ ID NO: 7239 - DNA, 46 bp, Artificial Sequence
  Synthesized adaptor oligonucleotide
  misc_feature (34)..(36): n is a, c, g, or t
tgcaggaccagagaattcgaatacactctactgnnnacgtatgcca

SEQ ID NO: 7240 - DNA, 46 bp, Artificial Sequence
  Synthesized adaptor oligonucleotide
  misc_feature (34)..(36): n is a, c, g, or t
tgcaggaccagagaattcgaatacaaggtgagtnnnacgtatgcca

SEQ ID NO: 7241 - DNA, 46 bp, Artificial Sequence
  Synthesized adaptor oligonucleotide
  misc_feature (34)..(36): n is a, c, g, or t
tgcaggaccagagaattcgaatacagaacactcnnnacgtatgcca

SEQ ID NO: 7242 - DNA, 46 bp, Artificial Sequence
  Synthesized adaptor oligonucleotide
  misc_feature (34)..(36): n is a, c, g, or t
tgcaggaccagagaattcgaatacaggcagagcnnnacgtatgcca

SEQ ID NO: 7243 - DNA, 46 bp, Artificial Sequence
  Synthesized adaptor oligonucleotide
  misc_feature (34)..(36): n is a, c, g, or t
tgcaggaccagagaattcgaatacatttccagcnnnacgtatgcca

SEQ ID NO: 7244 - DNA, 46 bp, Artificial Sequence
  Synthesized adaptor oligonucleotide
  misc_feature (34)..(36): n is a, c, g, or t
tgcaggaccagagaattcgaatacacccatcatnnnacgtatgcca

SEQ ID NO: 7245 - DNA, 46 bp, Artificial Sequence
  Synthesized adaptor oligonucleotide
  misc_feature (34)..(36): n is a, c, g, or t
tgcaggaccagagaattcgaatacaatcagcgtnnnacgtatgcca

SEQ ID NO: 7246 - DNA, 46 bp, Artificial Sequence
  Synthesized adaptor oligonucleotide
  misc_feature (34)..(36): n is a, c, g, or t
tgcaggaccagagaattcgaatacatgaaaaacnnnacgtatgcca

SEQ ID NO: 7247 - DNA, 46 bp, Artificial Sequence
  Synthesized adaptor oligonucleotide
  misc_feature (34)..(36): n is a, c, g, or t
tgcaggaccagagaattcgaatacaatgcggaannnacgtatgcca

SEQ ID NO: 7248 - DNA, 46 bp, Artificial Sequence
  Synthesized adaptor oligonucleotide
  misc_feature (34)..(36): n is a, c, g, or t
tgcaggaccagagaattcgaatacacggattcannnacgtatgcca

SEQ ID NO: 7249 - DNA, 46 bp, Artificial Sequence
  Synthesized adaptor oligonucleotide
  misc_feature (34)..(36): n is a, c, g, or t
tgcaggaccagagaattcgaatacagtcatacgnnnacgtatgcca

SEQ ID NO: 7250 - DNA, 46 bp, Artificial Sequence
  Synthesized adaptor oligonucleotide
  misc_feature (34)..(36): n is a, c, g, or t
tgcaggaccagagaattcgaatacaacctgcttnnnacgtatgcca

SEQ ID NO: 7251 - DNA, 46 bp, Artificial Sequence
  Synthesized adaptor oligonucleotide
  misc_feature (34)..(36): n is a, c, g, or t
tgcaggaccagagaattcgaatacagttgtgcannnacgtatgcca

SEQ ID NO: 7252 - DNA, 46 bp, Artificial Sequence
  Synthesized adaptor oligonucleotide
  misc_feature (34)..(36): n is a, c, g, or t
tgcaggaccagagaattcgaatacagaaatcggnnnacgtatgcca

SEQ ID NO: 7253 - DNA, 46 bp, Artificial Sequence
  Synthesized adaptor oligonucleotide
  misc_feature (34)..(36): n is a, c, g, or t
tgcaggaccagagaattcgaatacaaagttagannnacgtatgcca

SEQ ID NO: 7254 - DNA, 46 bp, Artificial Sequence
  Synthesized adaptor oligonucleotide
  misc_feature (34)..(36): n is a, c, g, or t
tgcaggaccagagaattcgaatacatgtaacgcnnnacgtatgcca

SEQ ID NO: 7255 - DNA, 46 bp, Artificial Sequence
  Synthesized adaptor oligonucleotide
  misc_feature (34)..(36): n is a, c, g, or t
tgcaggaccagagaattcgaatacagttttgaannnacgtatgcca

SEQ ID NO: 7256 - DNA, 46 bp, Artificial Sequence
  Synthesized adaptor oligonucleotide
  misc_feature (34)..(36): n is a, c, g, or t
tgcaggaccagagaattcgaatacacaaactgcnnnacgtatgcca

SEQ ID NO: 7257 - DNA, 46 bp, Artificial Sequence
  Synthesized adaptor oligonucleotide
  misc_feature (34)..(36): n is a, c, g, or t
tgcaggaccagagaattcgaatacagcctgagcnnnacgtatgcca

SEQ ID NO: 7258 - DNA, 46 bp, Artificial Sequence
  Synthesized adaptor oligonucleotide
  misc_feature (34)..(36): n is a, c, g, or t
tgcaggaccagagaattcgaatacatcttccagnnnacgtatgcca

SEQ ID NO: 7259 - DNA, 46 bp, Artificial Sequence
  Synthesized adaptor oligonucleotide
  misc_feature (34)..(36): n is a, c, g, or t
tgcaggaccagagaattcgaatacataccctacnnnacgtatgcca

SEQ ID NO: 7260 - DNA, 46 bp, Artificial Sequence
  Synthesized adaptor oligonucleotide
  misc_feature (34)..(36): n is a, c, g, or t
tgcaggaccagagaattcgaatacatcatagatnnnacgtatgcca

SEQ ID NO: 7261 - DNA, 46 bp, Artificial Sequence
  Synthesized adaptor oligonucleotide
  misc_feature (34)..(36): n is a, c, g, or t
tgcaggaccagagaattcgaatacagtatagaannnacgtatgcca

SEQ ID NO: 7262 - DNA, 46 bp, Artificial Sequence
  Synthesized adaptor oligonucleotide
  misc_feature (34)..(36): n is a, c, g, or t
tgcaggaccagagaattcgaatacaccctaaagnnnacgtatgcca

SEQ ID NO: 7263 - DNA, 46 bp, Artificial Sequence
  Synthesized adaptor oligonucleotide
  misc_feature (34)..(36): n is a, c, g, or t
tgcaggaccagagaattcgaatacagcggtttannnacgtatgcca

SEQ ID NO: 7264 - DNA, 46 bp, Artificial Sequence
  Synthesized adaptor oligonucleotide
  misc_feature (34)..(36): n is a, c, g, or t
tgcaggaccagagaattcgaatacatagctcagnnnacgtatgcca

SEQ ID NO: 7265 - DNA, 46 bp, Artificial Sequence
  Synthesized adaptor oligonucleotide
  misc_feature (34)..(36): n is a, c, g, or t
tgcaggaccagagaattcgaatacaccgtcccannnacgtatgcca

SEQ ID NO: 7266 - DNA, 46 bp, Artificial Sequence
  Synthesized adaptor oligonucleotide
  misc_feature (34)..(36): n is a, c, g, or t
tgcaggaccagagaattcgaatacaagtgcgaannnacgtatgcca

SEQ ID NO: 7267 - DNA, 46 bp, Artificial Sequence
  Synthesized adaptor oligonucleotide
  misc_feature (34)..(36): n is a, c, g, or t
tgcaggaccagagaattcgaatacatgagcttgnnnacgtatgcca

SEQ ID NO: 7268 - DNA, 46 bp, Artificial Sequence
  Synthesized adaptor oligonucleotide
  misc_feature (34)..(36): n is a, c, g, or t
tgcaggaccagagaattcgaatacatatcgtggnnnacgtatgcca

SEQ ID NO: 7269 - DNA, 46 bp, Artificial Sequence
  Synthesized adaptor oligonucleotide
  misc_feature (34)..(36): n is a, c, g, or t
tgcaggaccagagaattcgaatacatcagacacnnnctagcgttac

SEQ ID NO: 7270 - DNA, 46 bp, Artificial Sequence
  Synthesized adaptor oligonucleotide
  misc_feature (34)..(36): n is a, c, g, or t
tgcaggaccagagaattcgaatacatacccttgnnnctagcgttac

SEQ ID NO: 7271 - DNA, 46 bp, Artificial Sequence
  Synthesized adaptor oligonucleotide
  misc_feature (34)..(36): n is a, c, g, or t
tgcaggaccagagaattcgaatacacatcgagtnnnctagcgttac

SEQ ID NO: 7272 - DNA, 46 bp, Artificial Sequence
  Synthesized adaptor oligonucleotide
  misc_feature (34)..(36): n is a, c, g, or t
tgcaggaccagagaattcgaatacatgaatctannnctagcgttac

SEQ ID NO: 7273 - DNA, 46 bp, Artificial Sequence
  Synthesized adaptor oligonucleotide
  misc_feature (34)..(36): n is a, c, g, or t
tgcaggaccagagaattcgaatacaagtggagtnnnctagcgttac

SEQ ID NO: 7274 - DNA, 46 bp, Artificial Sequence
  Synthesized adaptor oligonucleotide
  misc_feature (34)..(36): n is a, c, g, or t
tgcaggaccagagaattcgaatacactgaaggannnctagcgttac

SEQ ID NO: 7275 - DNA, 46 bp, Artificial Sequence
  Synthesized adaptor oligonucleotide
  misc_feature (34)..(36): n is a, c, g, or t
tgcaggaccagagaattcgaatacaaatcagttnnnctagcgttac

SEQ ID NO: 7276 - DNA, 46 bp, Artificial Sequence
  Synthesized adaptor oligonucleotide
  misc_feature (34)..(36): n is a, c, g, or t
tgcaggaccagagaattcgaatacacgcaggctnnnctagcgttac

SEQ ID NO: 7277 - DNA, 46 bp, Artificial Sequence
  Synthesized adaptor oligonucleotide
  misc_feature (34)..(36): n is a, c, g, or t
tgcaggaccagagaattcgaatacacggtgcacnnnctagcgttac

SEQ ID NO: 7278 - DNA, 46 bp, Artificial Sequence
  Synthesized adaptor oligonucleotide
  misc_feature (34)..(36): n is a, c, g, or t
tgcaggaccagagaattcgaatacacgtatcagnnnctagcgttac

SEQ ID NO: 7279 - DNA, 46 bp, Artificial Sequence
  Synthesized adaptor oligonucleotide
  misc_feature (34)..(36): n is a, c, g, or t
tgcaggaccagagaattcgaatacataacgctgnnnctagcgttac

SEQ ID NO: 7280 - DNA, 46 bp, Artificial Sequence
  Synthesized adaptor oligonucleotide
  misc_feature (34)..(36): n is a, c, g, or t
tgcaggaccagagaattcgaatacaaccgtacannnctagcgttac

SEQ ID NO: 7281 - DNA, 46 bp, Artificial Sequence
  Synthesized adaptor oligonucleotide
  misc_feature (34)..(36): n is a, c, g, or t
tgcaggaccagagaattcgaatacagcttagtgnnnctagcgttac

SEQ ID NO: 7282 - DNA, 46 bp, Artificial Sequence
  Synthesized adaptor oligonucleotide
  misc_feature (34)..(36): n is a, c, g, or t
tgcaggaccagagaattcgaatacacgaacgccnnnctagcgttac

SEQ ID NO: 7283 - DNA, 46 bp, Artificial Sequence
  Synthesized adaptor oligonucleotide
  misc_feature (34)..(36): n is a, c, g, or t
tgcaggaccagagaattcgaatacagtatcgtgnnnctagcgttac

SEQ ID NO: 7284 - DNA, 46 bp, Artificial Sequence
  Synthesized adaptor oligonucleotide
  misc_feature (34)..(36): n is a, c, g, or t
tgcaggaccagagaattcgaatacatacaaatcnnnctagcgttac

SEQ ID NO: 7285 - DNA, 46 bp, Artificial Sequence
  Synthesized adaptor oligonucleotide
  misc_feature (34)..(36): n is a, c, g, or t
tgcaggaccagagaattcgaatacacgtccttannnctagcgttac

SEQ ID NO: 7286 - DNA, 46 bp, Artificial Sequence
  Synthesized adaptor oligonucleotide
  misc_feature (34)..(36): n is a, c, g, or t
tgcaggaccagagaattcgaatacaagaccactnnnctagcgttac

SEQ ID NO: 7287 - DNA, 46 bp, Artificial Sequence
  Synthesized adaptor oligonucleotide
  misc_feature (34)..(36): n is a, c, g, or t
tgcaggaccagagaattcgaatacaacaaggtgnnnctagcgttac

SEQ ID NO: 7288 - DNA, 46 bp, Artificial Sequence
  Synthesized adaptor oligonucleotide
  misc_feature (34)..(36): n is a, c, g, or t
tgcaggaccagagaattcgaatacaatacttgannnctagcgttac

SEQ ID NO: 7289 - DNA, 46 bp, Artificial Sequence
  Synthesized adaptor oligonucleotide
  misc_feature (34)..(36): n is a, c, g, or t
tgcaggaccagagaattcgaatacacttccgatnnnctagcgttac

SEQ ID NO: 7290 - DNA, 46 bp, Artificial Sequence
  Synthesized adaptor oligonucleotide
  misc_feature (34)..(36): n is a, c, g, or t
tgcaggaccagagaattcgaatacacgtcttgtnnnctagcgttac

SEQ ID NO: 7291 - DNA, 46 bp, Artificial Sequence
  Synthesized adaptor oligonucleotide
  misc_feature (34)..(36): n is a, c, g, or t
tgcaggaccagagaattcgaatacaaagtggtgnnnctagcgttac

SEQ ID NO: 7292 - DNA, 46 bp, Artificial Sequence
  Synthesized adaptor oligonucleotide
  misc_feature (34)..(36): n is a, c, g, or t
tgcaggaccagagaattcgaatacatcggtggcnnnctagcgttac

SEQ ID NO: 7293 - DNA, 46 bp, Artificial Sequence
  Synthesized adaptor oligonucleotide
  misc_feature (34)..(36): n is a, c, g, or t
tgcaggaccagagaattcgaatacaaaaatcagnnnctagcgttac

SEQ ID NO: 7294 - DNA, 46 bp, Artificial Sequence
  Synthesized adaptor oligonucleotide
  misc_feature (34)..(36): n is a, c, g, or t
tgcaggaccagagaattcgaatacatcccgcgtnnnctagcgttac

SEQ ID NO: 7295 - DNA, 46 bp, Artificial Sequence
  Synthesized adaptor oligonucleotide
  misc_feature (34)..(36): n is a, c, g, or t
tgcaggaccagagaattcgaatacaggcacgctnnnctagcgttac

SEQ ID NO: 7296 - DNA, 46 bp, Artificial Sequence
  Synthesized adaptor oligonucleotide
  misc_feature (34)..(36): n is a, c, g, or t
tgcaggaccagagaattcgaatacagctgtcttnnnctagcgttac

SEQ ID NO: 7297 - DNA, 46 bp, Artificial Sequence
  Synthesized adaptor oligonucleotide
  misc_feature (34)..(36): n is a, c, g, or t
tgcaggaccagagaattcgaatacaagcataaannnctagcgttac

SEQ ID NO: 7298 - DNA, 46 bp, Artificial Sequence
  Synthesized adaptor oligonucleotide
  misc_feature (34)..(36): n is a, c, g, or t
tgcaggaccagagaattcgaatacatgcgaatcnnnctagcgttac

SEQ ID NO: 7299 - DNA, 46 bp, Artificial Sequence
  Synthesized adaptor oligonucleotide
  misc_feature (34)..(36): n is a, c, g, or t
tgcaggaccagagaattcgaatacacgtttcgtnnnctagcgttac

SEQ ID NO: 7300 - DNA, 46 bp, Artificial Sequence
  Synthesized adaptor oligonucleotide
  misc_feature (34)..(36): n is a, c, g, or t
tgcaggaccagagaattcgaatacagcactcttnnnctagcgttac

SEQ ID NO: 7301 - DNA, 46 bp, Artificial Sequence
  Synthesized adaptor oligonucleotide
  misc_feature (34)..(36): n is a, c, g, or t
tgcaggaccagagaattcgaatacactcgctgcnnnctagcgttac

SEQ ID NO: 7302 - DNA, 46 bp, Artificial Sequence
  Synthesized adaptor oligonucleotide
  misc_feature (34)..(36): n is a, c, g, or t
tgcaggaccagagaattcgaatacacatacagcnnnctagcgttac

SEQ ID NO: 7303 - DNA, 46 bp, Artificial Sequence
  Synthesized adaptor oligonucleotide
  misc_feature (34)..(36): n is a, c, g, or t
tgcaggaccagagaattcgaatacagagcaaacnnnctagcgttac

SEQ ID NO: 7304 - DNA, 46 bp, Artificial Sequence
  Synthesized adaptor oligonucleotide
  misc_feature (34)..(36): n is a, c, g, or t
tgcaggaccagagaattcgaatacagcttccatnnnctagcgttac

SEQ ID NO: 7305 - DNA, 46 bp, Artificial Sequence
  Synthesized adaptor oligonucleotide
  misc_feature (34)..(36): n is a, c, g, or t
tgcaggaccagagaattcgaatacacctaatttnnnctagcgttac

SEQ ID NO: 7306 - DNA, 46 bp, Artificial Sequence
  Synthesized adaptor oligonucleotide
  misc_feature (34)..(36): n is a, c, g, or t
tgcaggaccagagaattcgaatacaagcccgacnnnctagcgttac

SEQ ID NO: 7307 - DNA, 46 bp, Artificial Sequence
  Synthesized adaptor oligonucleotide
  misc_feature (34)..(36): n is a, c, g, or t
tgcaggaccagagaattcgaatacatggtgaagnnnctagcgttac

SEQ ID NO: 7308 - DNA, 46 bp, Artificial Sequence
  Synthesized adaptor oligonucleotide
  misc_feature (34)..(36): n is a, c, g, or t
tgcaggaccagagaattcgaatacaatcgctgannnctagcgttac

SEQ ID NO: 7309 - DNA, 46 bp, Artificial Sequence
  Synthesized adaptor oligonucleotide
  misc_feature (34)..(36): n is a, c, g, or t
tgcaggaccagagaattcgaatacattactgccnnnctagcgttac

SEQ ID NO: 7310 - DNA, 46 bp, Artificial Sequence
  Synthesized adaptor oligonucleotide
  misc_feature (34)..(36): n is a, c, g, or t
tgcaggaccagagaattcgaatacaggaggccannnctagcgttac

SEQ ID NO: 7311 - DNA, 46 bp, Artificial Sequence
  Synthesized adaptor oligonucleotide
  misc_feature (34)..(36): n is a, c, g, or t
tgcaggaccagagaattcgaatacatacctgtcnnnctagcgttac

SEQ ID NO: 7312 - DNA, 46 bp, Artificial Sequence
  Synthesized adaptor oligonucleotide
  misc_feature (34)..(36): n is a, c, g, or t
tgcaggaccagagaattcgaatacaatatgctannnctagcgttac

SEQ ID NO: 7313 - DNA, 46 bp, Artificial Sequence
  Synthesized adaptor oligonucleotide
  misc_feature (34)..(36): n is a, c, g, or t
tgcaggaccagagaattcgaatacagatcaccannnctagcgttac

SEQ ID NO: 7314 - DNA, 46 bp, Artificial Sequence
  Synthesized adaptor oligonucleotide
  misc_feature (34)..(36): n is a, c, g, or t
tgcaggaccagagaattcgaatacagcggaacgnnnctagcgttac

SEQ ID NO: 7315 - DNA, 46 bp, Artificial Sequence
  Synthesized adaptor oligonucleotide
  misc_feature (34)..(36): n is a, c, g, or t
tgcaggaccagagaattcgaatacaaatcctttnnnctagcgttac

SEQ ID NO: 7316 - DNA, 46 bp, Artificial Sequence
  Synthesized adaptor oligonucleotide
  misc_feature (34)..(36): n is a, c, g, or t
tgcaggaccagagaattcgaatacatactatagnnnctagcgttac

SEQ ID NO: 7317 - DNA, 46 bp, Artificial Sequence
  Synthesized adaptor oligonucleotide
  misc_feature (34)..(36): n is a, c, g, or t
tgcaggaccagagaattcgaatacagtctgtagnnnctagcgttac

SEQ ID NO: 7318 - DNA, 46 bp, Artificial Sequence
  Synthesized adaptor oligonucleotide
  misc_feature (34)..(36): n is a, c, g, or t
tgcaggaccagagaattcgaatacagactatcgnnnctagcgttac

SEQ ID NO: 7319 - DNA, 46 bp, Artificial Sequence
  Synthesized adaptor oligonucleotide
  misc_feature (34)..(36): n is a, c, g, or t
tgcaggaccagagaattcgaatacaaggattaannnctagcgttac

SEQ ID NO: 7320 - DNA, 46 bp, Artificial Sequence
  Synthesized adaptor oligonucleotide
  misc_feature (34)..(36): n is a, c, g, or t
tgcaggaccagagaattcgaatacattacatctnnnctagcgttac

SEQ ID NO: 7321 - DNA, 46 bp, Artificial Sequence
  Synthesized adaptor oligonucleotide
  misc_feature (34)..(36): n is a, c, g, or t
tgcaggaccagagaattcgaatacatttggcagnnnctagcgttac

SEQ ID NO: 7322 - DNA, 46 bp, Artificial Sequence
  Synthesized adaptor oligonucleotide
  misc_feature (34)..(36): n is a, c, g, or t
tgcaggaccagagaattcgaatacacagtatgcnnnctagcgttac

SEQ ID NO: 7323 - DNA, 46 bp, Artificial Sequence
  Synthesized adaptor oligonucleotide
  misc_feature (34)..(36): n is a, c, g, or t
tgcaggaccagagaattcgaatacattcgatccnnnctagcgttac

SEQ ID NO: 7324 - DNA, 46 bp, Artificial Sequence
  Synthesized adaptor oligonucleotide
  misc_feature (34)..(36): n is a, c, g, or t
tgcaggaccagagaattcgaatacaaatcccctnnnctagcgttac

SEQ ID NO: 7325 - DNA, 46 bp, Artificial Sequence
  Synthesized adaptor oligonucleotide
  misc_feature (34)..(36): n is a, c, g, or t
tgcaggaccagagaattcgaatacactctccccnnnctagcgttac

SEQ ID NO: 7326 - DNA, 46 bp, Artificial Sequence
  Synthesized adaptor oligonucleotide
  misc_feature (34)..(36): n is a, c, g, or t
tgcaggaccagagaattcgaatacacaattaacnnnctagcgttac

SEQ ID NO: 7327 - DNA, 46 bp, Artificial Sequence
  Synthesized adaptor oligonucleotide
  misc_feature (34)..(36): n is a, c, g, or t
tgcaggaccagagaattcgaatacaattttgctnnnctagcgttac

SEQ ID NO: 7328 - DNA, 46 bp, Artificial Sequence
  Synthesized adaptor oligonucleotide
  misc_feature (34)..(36): n is a, c, g, or t
tgcaggaccagagaattcgaatacaataaatccnnnctagcgttac

SEQ ID NO: 7329 - DNA, 46 bp, Artificial Sequence
  Synthesized adaptor oligonucleotide
  misc_feature (34)..(36): n is a, c, g, or t
tgcaggaccagagaattcgaatacatactcgtcnnngatcgacatg

SEQ ID NO: 7330 - DNA, 46 bp, Artificial Sequence
  Synthesized adaptor oligonucleotide
  misc_feature (34)..(36): n is a, c, g, or t
tgcaggaccagagaattcgaatacaatgcgaagnnngatcgacatg

SEQ ID NO: 7331 - DNA, 46 bp, Artificial Sequence
  Synthesized adaptor oligonucleotide
  misc_feature (34)..(36): n is a, c, g, or t
tgcaggaccagagaattcgaatacatgcgcagcnnngatcgacatg

SEQ ID NO: 7332 - DNA, 46 bp, Artificial Sequence
  Synthesized adaptor oligonucleotide
  misc_feature (34)..(36): n is a, c, g, or t
tgcaggaccagagaattcgaatacatggtaaaannngatcgacatg

SEQ ID NO: 7333 - DNA, 46 bp, Artificial Sequence
  Synthesized adaptor oligonucleotide
  misc_feature (34)..(36): n is a, c, g, or t
tgcaggaccagagaattcgaatacacactccatnnngatcgacatg

SEQ ID NO: 7334 - DNA, 46 bp, Artificial Sequence
  Synthesized adaptor oligonucleotide
  misc_feature (34)..(36): n is a, c, g, or t
tgcaggaccagagaattcgaatacacctatggannngatcgacatg

SEQ ID NO: 7335 - DNA, 46 bp, Artificial Sequence
  Synthesized adaptor oligonucleotide
  misc_feature (34)..(36): n is a, c, g, or t
tgcaggaccagagaattcgaatacaatgctcctnnngatcgacatg

SEQ ID NO: 7336 - DNA, 46 bp, Artificial Sequence
  Synthesized adaptor oligonucleotide
  misc_feature (34)..(36): n is a, c, g, or t
tgcaggaccagagaattcgaatacagattgaaannngatcgacatg

SEQ ID NO: 7337 - DNA, 46 bp, Artificial Sequence
  Synthesized adaptor oligonucleotide
  misc_feature (34)..(36): n is a, c, g, or t
tgcaggaccagagaattcgaatacaacacccaannngatcgacatg

SEQ ID NO: 7338 - DNA, 46 bp, Artificial Sequence
  Synthesized adaptor oligonucleotide
  misc_feature (34)..(36): n is a, c, g, or t
tgcaggaccagagaattcgaatacaccggcatgnnngatcgacatg

SEQ ID NO: 7339 - DNA, 46 bp, Artificial Sequence
  Synthesized adaptor oligonucleotide
  misc_feature (34)..(36): n is a, c, g, or t
tgcaggaccagagaattcgaatacatccgattcnnngatcgacatg

SEQ ID NO: 7340 - DNA, 46 bp, Artificial Sequence
  Synthesized adaptor oligonucleotide
  misc_feature (34)..(36): n is a, c, g, or t
tgcaggaccagagaattcgaatacagaatcctgnnngatcgacatg

SEQ ID NO: 7341 - DNA, 46 bp, Artificial Sequence
  Synthesized adaptor oligonucleotide
  misc_feature (34)..(36): n is a, c, g, or t
tgcaggaccagagaattcgaatacatttcgtcgnnngatcgacatg

SEQ ID NO: 7342 - DNA, 46 bp, Artificial Sequence
  Synthesized adaptor oligonucleotide
  misc_feature (34)..(36): n is a, c, g, or t
tgcaggaccagagaattcgaatacacttcactgnnngatcgacatg

SEQ ID NO: 7343 - DNA, 46 bp, Artificial Sequence
  Synthesized adaptor oligonucleotide
  misc_feature (34)..(36): n is a, c, g, or t
tgcaggaccagagaattcgaatacaccctattgnnngatcgacatg

SEQ ID NO: 7344 - DNA, 46 bp, Artificial Sequence
  Synthesized adaptor oligonucleotide
  misc_feature (34)..(36): n is a, c, g, or t
tgcaggaccagagaattcgaatacaagtagtaannngatcgacatg

SEQ ID NO: 7345 - DNA, 46 bp, Artificial Sequence
  Synthesized adaptor oligonucleotide
  misc_feature (34)..(36): n is a, c, g, or t
tgcaggaccagagaattcgaatacacaccgtaannngatcgacatg

SEQ ID NO: 7346 - DNA, 46 bp, Artificial Sequence
  Synthesized adaptor oligonucleotide
  misc_feature (34)..(36): n is a, c, g, or t
tgcaggaccagagaattcgaatacatgtttccgnnngatcgacatg

SEQ ID NO: 7347 - DNA, 46 bp, Artificial Sequence
  Synthesized adaptor oligonucleotide
  misc_feature (34)..(36): n is a, c, g, or t
tgcaggaccagagaattcgaatacagctggaccnnngatcgacatg

SEQ ID NO: 7348 - DNA, 46 bp, Artificial Sequence
  Synthesized adaptor oligonucleotide
  misc_feature (34)..(36): n is a, c, g, or t
tgcaggaccagagaattcgaatacagtaattgtnnngatcgacatg

SEQ ID NO: 7349 - DNA, 46 bp, Artificial Sequence
  Synthesized adaptor oligonucleotide
  misc_feature (34)..(36): n is a, c, g, or t
tgcaggaccagagaattcgaatacaagcttatannngatcgacatg

SEQ ID NO: 7350 - DNA, 46 bp, Artificial Sequence
  Synthesized adaptor oligonucleotide
  misc_feature (34)..(36): n is a, c, g, or t
tgcaggaccagagaattcgaatacagctaccaannngatcgacatg

SEQ ID NO: 7351 - DNA, 46 bp, Artificial Sequence
  Synthesized adaptor oligonucleotide
  misc_feature (34)..(36): n is a, c, g, or t
tgcaggaccagagaattcgaatacagataatgannngatcgacatg

SEQ ID NO: 7352 - DNA, 46 bp, Artificial Sequence
  Synthesized adaptor oligonucleotide
  misc_feature (34)..(36): n is a, c, g, or t
tgcaggaccagagaattcgaatacaaaatcatcnnngatcgacatg

SEQ ID NO: 7353 - DNA, 46 bp, Artificial Sequence
  Synthesized adaptor oligonucleotide
  misc_feature (34)..(36): n is a, c, g, or t
tgcaggaccagagaattcgaatacaaatagcccnnngatcgacatg

SEQ ID NO: 7354 - DNA, 46 bp, Artificial Sequence
  Synthesized adaptor oligonucleotide
  misc_feature (34)..(36): n is a, c, g, or t
tgcaggaccagagaattcgaatacatgctgcttnnngatcgacatg

SEQ ID NO: 7355 - DNA, 46 bp, Artificial Sequence
  Synthesized adaptor oligonucleotide
  misc_feature (34)..(36): n is a, c, g, or t
tgcaggaccagagaattcgaatacattacgcagnnngatcgacatg

SEQ ID NO: 7356 - DNA, 46 bp, Artificial Sequence
  Synthesized adaptor oligonucleotide
  misc_feature (34)..(36): n is a, c, g, or t
tgcaggaccagagaattcgaatacacccagcctnnngatcgacatg

SEQ ID NO: 7357 - DNA, 46 bp, Artificial Sequence
  Synthesized adaptor oligonucleotide
  misc_feature (34)..(36): n is a, c, g, or t
tgcaggaccagagaattcgaatacaccatttatnnngatcgacatg

SEQ ID NO: 7358 - DNA, 46 bp, Artificial Sequence
  Synthesized adaptor oligonucleotide
  misc_feature (34)..(36): n is a, c, g, or t
tgcaggaccagagaattcgaatacagtgcaatcnnngatcgacatg

SEQ ID NO: 7359 - DNA, 46 bp, Artificial Sequence
  Synthesized adaptor oligonucleotide
  misc_feature (34)..(36): n is a, c, g, or t
tgcaggaccagagaattcgaatacacatcaggtnnngatcgacatg

SEQ ID NO: 7360 - DNA, 46 bp, Artificial Sequence
  Synthesized adaptor oligonucleotide
  misc_feature (34)..(36): n is a, c, g, or t
tgcaggaccagagaattcgaatacaggcccacannngatcgacatg

SEQ ID NO: 7361 - DNA, 46 bp, Artificial Sequence
  Synthesized adaptor oligonucleotide
  misc_feature (34)..(36): n is a, c, g, or t
tgcaggaccagagaattcgaatacaaagcacgannngatcgacatg

SEQ ID NO: 7362 - DNA, 46 bp, Artificial Sequence
  Synthesized adaptor oligonucleotide
  misc_feature (34)..(36): n is a, c, g, or t
tgcaggaccagagaattcgaatacacacaggaannngatcgacatg

SEQ ID NO: 7363 - DNA, 46 bp, Artificial Sequence
  Synthesized adaptor oligonucleotide
  misc_feature (34)..(36): n is a, c, g, or t
tgcaggaccagagaattcgaatacagcagcctgnnngatcgacatg

SEQ ID NO: 7364 - DNA, 46 bp, Artificial Sequence
  Synthesized adaptor oligonucleotide
  misc_feature (34)..(36): n is a, c, g, or t
tgcaggaccagagaattcgaatacaggctgcgtnnngatcgacatg

SEQ ID NO: 7365 - DNA, 46 bp, Artificial Sequence
  Synthesized adaptor oligonucleotide
  misc_feature (34)..(36): n is a, c, g, or t
tgcaggaccagagaattcgaatacactctagctnnngatcgacatg

SEQ ID NO: 7366 - DNA, 46 bp, Artificial Sequence
  Synthesized adaptor oligonucleotide
  misc_feature (34)..(36): n is a, c, g, or t
tgcaggaccagagaattcgaatacagaaggctannngatcgacatg

SEQ ID NO: 7367 - DNA, 46 bp, Artificial Sequence
  Synthesized adaptor oligonucleotide
  misc_feature (34)..(36): n is a, c, g, or t
tgcaggaccagagaattcgaatacatatctgaannngatcgacatg

SEQ ID NO: 7368 - DNA, 46 bp, Artificial Sequence
  Synthesized adaptor oligonucleotide
  misc_feature (34)..(36): n is a, c, g, or t
tgcaggaccagagaattcgaatacatactattcnnngatcgacatg

SEQ ID NO: 7369 - DNA, 46 bp, Artificial Sequence
  Synthesized adaptor oligonucleotide
  misc_feature (34)..(36): n is a, c, g, or t
tgcaggaccagagaattcgaatacacatgaccannngatcgacatg

SEQ ID NO: 7370 - DNA, 46 bp, Artificial Sequence
  Synthesized adaptor oligonucleotide
  misc_feature (34)..(36): n is a, c, g, or t
tgcaggaccagagaattcgaatacaattcaggcnnngatcgacatg

SEQ ID NO: 7371 - DNA, 46 bp, Artificial Sequence
  Synthesized adaptor oligonucleotide
  misc_feature (34)..(36): n is a, c, g, or t
tgcaggaccagagaattcgaatacaaaccaaccnnngatcgacatg

SEQ ID NO: 7372 - DNA, 46 bp, Artificial Sequence
  Synthesized adaptor oligonucleotide
  misc_feature (34)..(36): n is a, c, g, or t
tgcaggaccagagaattcgaatacattactgttnnngatcgacatg

SEQ ID NO: 7373 - DNA, 46 bp, Artificial Sequence
  Synthesized adaptor oligonucleotide
  misc_feature (34)..(36): n is a, c, g, or t
tgcaggaccagagaattcgaatacaggttccccnnngatcgacatg

SEQ ID NO: 7374 - DNA, 46 bp, Artificial Sequence
  Synthesized adaptor oligonucleotide
  misc_feature (34)..(36): n is a, c, g, or t
tgcaggaccagagaattcgaatacaataaacctnnngatcgacatg

SEQ ID NO: 7375 - DNA, 46 bp, Artificial Sequence
  Synthesized adaptor oligonucleotide
  misc_feature (34)..(36): n is a, c, g, or t
tgcaggaccagagaattcgaatacatttcgtgcnnngatcgacatg

SEQ ID NO: 7376 - DNA, 46 bp, Artificial Sequence
  Synthesized adaptor oligonucleotide
  misc_feature (34)..(36): n is a, c, g, or t
tgcaggaccagagaattcgaatacagtgaccatnnngatcgacatg

SEQ ID NO: 7377 - DNA, 46 bp, Artificial Sequence
  Synthesized adaptor oligonucleotide
  misc_feature (34)..(36): n is a, c, g, or t
tgcaggaccagagaattcgaatacaccctatacnnngatcgacatg

SEQ ID NO: 7378 - DNA, 46 bp, Artificial Sequence
  Synthesized adaptor oligonucleotide
  misc_feature (34)..(36): n is a, c, g, or t
tgcaggaccagagaattcgaatacaccccatatnnngatcgacatg

SEQ ID NO: 7379 - DNA, 46 bp, Artificial Sequence
  Synthesized adaptor oligonucleotide
  misc_feature (34)..(36): n is a, c, g, or t
tgcaggaccagagaattcgaatacagataggtgnnngatcgacatg

SEQ ID NO: 7380 - DNA, 46 bp, Artificial Sequence
  Synthesized adaptor oligonucleotide
  misc_feature (34)..(36): n is a, c, g, or t
tgcaggaccagagaattcgaatacaaaataacgnnngatcgacatg

SEQ ID NO: 7381 - DNA, 46 bp, Artificial Sequence
  Synthesized adaptor oligonucleotide
  misc_feature (34)..(36): n is a, c, g, or t
tgcaggaccagagaattcgaatacaataatcgtnnngatcgacatg

SEQ ID NO: 7382 - DNA, 46 bp, Artificial Sequence
  Synthesized adaptor oligonucleotide
  misc_feature (34)..(36): n is a, c, g, or t
tgcaggaccagagaattcgaatacagtggacttnnngatcgacatg

SEQ ID NO: 7383 - DNA, 46 bp, Artificial Sequence
  Synthesized adaptor oligonucleotide
  misc_feature (34)..(36): n is a, c, g, or t
tgcaggaccagagaattcgaatacagttactggnnngatcgacatg

SEQ ID NO: 7384 - DNA, 46 bp, Artificial Sequence
  Synthesized adaptor oligonucleotide
  misc_feature (34)..(36): n is a, c, g, or t
tgcaggaccagagaattcgaatacatcctaggannngatcgacatg

SEQ ID NO: 7385 - DNA, 46 bp, Artificial Sequence
  Synthesized adaptor oligonucleotide
  misc_feature (34)..(36): n is a, c, g, or t
tgcaggaccagagaattcgaatacaaaacttacnnngatcgacatg

SEQ ID NO: 7386 - DNA, 46 bp, Artificial Sequence
  Synthesized adaptor oligonucleotide
  misc_feature (34)..(36): n is a, c, g, or t
tgcaggaccagagaattcgaatacaaagtgctcnnngatcgacatg

SEQ ID NO: 7387 - DNA, 46 bp, Artificial Sequence
  Synthesized adaptor oligonucleotide
  misc_feature (34)..(36): n is a, c, g, or t
tgcaggaccagagaattcgaatacagtattttcnnngatcgacatg

SEQ ID NO: 7388 - DNA, 46 bp, Artificial Sequence
  Synthesized adaptor oligonucleotide
  misc_feature (34)..(36): n is a, c, g, or t
tgcaggaccagagaattcgaatacagaaagctgnnngatcgacatg

SEQ ID NO: 7389 - DNA, 46 bp, Artificial Sequence
  Synthesized adaptor oligonucleotide
  misc_feature (34)..(36): n is a, c, g, or t
tgcaggaccagagaattcgaatacaatcacgacnnntgcatcaggt

SEQ ID NO: 7390 - DNA, 46 bp, Artificial Sequence
  Synthesized adaptor oligonucleotide
  misc_feature (34)..(36): n is a, c, g, or t
tgcaggaccagagaattcgaatacaaggaccttnnntgcatcaggt

SEQ ID NO: 7391 - DNA, 46 bp, Artificial Sequence
  Synthesized adaptor oligonucleotide
  misc_feature (34)..(36): n is a, c, g, or t
tgcaggaccagagaattcgaatacagaatgtaannntgcatcaggt

SEQ ID NO: 7392 - DNA, 46 bp, Artificial Sequence
  Synthesized adaptor oligonucleotide
  misc_feature (34)..(36): n is a, c, g, or t
tgcaggaccagagaattcgaatacaaaactgccnnntgcatcaggt

SEQ ID NO: 7393 - DNA, 46 bp, Artificial Sequence
  Synthesized adaptor oligonucleotide
  misc_feature (34)..(36): n is a, c, g, or t
tgcaggaccagagaattcgaatacaatacaatcnnntgcatcaggt

SEQ ID NO: 7394 - DNA, 46 bp, Artificial Sequence
  Synthesized adaptor oligonucleotide
  misc_feature (34)..(36): n is a, c, g, or t
tgcaggaccagagaattcgaatacagagcagcgnnntgcatcaggt

SEQ ID NO: 7395 - DNA, 46 bp, Artificial Sequence
  Synthesized adaptor oligonucleotide
  misc_feature (34)..(36): n is a, c, g, or t
tgcaggaccagagaattcgaatacatcgtgttcnnntgcatcaggt

SEQ ID NO: 7396 - DNA, 46 bp, Artificial Sequence
  Synthesized adaptor oligonucleotide
  misc_feature (34)..(36): n is a, c, g, or t
tgcaggaccagagaattcgaatacactgagccgnnntgcatcaggt

SEQ ID NO: 7397 - DNA, 46 bp, Artificial Sequence
  Synthesized adaptor oligonucleotide
  misc_feature (34)..(36): n is a, c, g, or t
tgcaggaccagagaattcgaatacacaagcagannntgcatcaggt

SEQ ID NO: 7398 - DNA, 46 bp, Artificial Sequence
  Synthesized adaptor oligonucleotide
  misc_feature (34)..(36): n is a, c, g, or t
tgcaggaccagagaattcgaatacagtcttaccnnntgcatcaggt

SEQ ID NO: 7399 - DNA, 46 bp, Artificial Sequence
  Synthesized adaptor oligonucleotide
  misc_feature (34)..(36): n is a, c, g, or t
tgcaggaccagagaattcgaatacacgtctccgnnntgcatcaggt

SEQ ID NO: 7400 - DNA, 46 bp, Artificial Sequence
  Synthesized adaptor oligonucleotide
  misc_feature (34)..(36): n is a, c, g, or t
tgcaggaccagagaattcgaatacaggcgttcgnnntgcatcaggt

SEQ ID NO: 7401 - DNA, 46 bp, Artificial Sequence
  Synthesized adaptor oligonucleotide
  misc_feature (34)..(36): n is a, c, g, or t
tgcaggaccagagaattcgaatacaccgcacctnnntgcatcaggt

SEQ ID NO: 7402 - DNA, 46 bp, Artificial Sequence
  Synthesized adaptor oligonucleotide
  misc_feature (34)..(36): n is a, c, g, or t
tgcaggaccagagaattcgaatacaagtggttcnnntgcatcaggt

SEQ ID NO: 7403 - DNA, 46 bp, Artificial Sequence
  Synthesized adaptor oligonucleotide
  misc_feature (34)..(36): n is a, c, g, or t
tgcaggaccagagaattcgaatacagttgcgtannntgcatcaggt

SEQ ID NO: 7404 - DNA, 46 bp, Artificial Sequence
  Synthesized adaptor oligonucleotide
  misc_feature (34)..(36): n is a, c, g, or t
tgcaggaccagagaattcgaatacaccaaatgcnnntgcatcaggt

SEQ ID NO: 7405 - DNA, 46 bp, Artificial Sequence
  Synthesized adaptor oligonucleotide
  misc_feature (34)..(36): n is a, c, g, or t
tgcaggaccagagaattcgaatacagctttgtcnnntgcatcaggt

SEQ ID NO: 7406 - DNA, 46 bp, Artificial Sequence
  Synthesized adaptor oligonucleotide
  misc_feature (34)..(36): n is a, c, g, or t
tgcaggaccagagaattcgaatacacttcaattnnntgcatcaggt

SEQ ID NO: 7407 - DNA, 46 bp, Artificial Sequence
  Synthesized adaptor oligonucleotide
  misc_feature (34)..(36): n is a, c, g, or t
tgcaggaccagagaattcgaatacagaatctgcnnntgcatcaggt

SEQ ID NO: 7408 - DNA, 46 bp, Artificial Sequence
  Synthesized adaptor oligonucleotide
  misc_feature (34)..(36): n is a, c, g, or t
tgcaggaccagagaattcgaatacaccaggaccnnntgcatcaggt

SEQ ID NO: 7409 - DNA, 46 bp, Artificial Sequence
  Synthesized adaptor oligonucleotide
  misc_feature (34)..(36): n is a, c, g, or t
tgcaggaccagagaattcgaatacaagagcatgnnntgcatcaggt

SEQ ID NO: 7410 - DNA, 46 bp, Artificial Sequence
  Synthesized adaptor oligonucleotide
  misc_feature (34)..(36): n is a, c, g, or t
tgcaggaccagagaattcgaatacaacggccacnnntgcatcaggt

SEQ ID NO: 7411 - DNA, 46 bp, Artificial Sequence
  Synthesized adaptor oligonucleotide
  misc_feature (34)..(36): n is a, c, g, or t
tgcaggaccagagaattcgaatacacctaaacgnnntgcatcaggt

SEQ ID NO: 7412 - DNA, 46 bp, Artificial Sequence
  Synthesized adaptor oligonucleotide
  misc_feature (34)..(36): n is a, c, g, or t
tgcaggaccagagaattcgaatacaggtaactcnnntgcatcaggt

SEQ ID NO: 7413 - DNA, 46 bp, Artificial Sequence
  Synthesized adaptor oligonucleotide
  misc_feature (34)..(36): n is a, c, g, or t
tgcaggaccagagaattcgaatacatggctgatnnntgcatcaggt

SEQ ID NO: 7414 - DNA, 46 bp, Artificial Sequence
  Synthesized adaptor oligonucleotide
  misc_feature (34)..(36): n is a, c, g, or t
tgcaggaccagagaattcgaatacagccgtagcnnntgcatcaggt

SEQ ID NO: 7415 - DNA, 46 bp, Artificial Sequence
  Synthesized adaptor oligonucleotide
  misc_feature (34)..(36): n is a, c, g, or t
tgcaggaccagagaattcgaatacatatcattcnnntgcatcaggt

SEQ ID NO: 7416 - DNA, 46 bp, Artificial Sequence
  Synthesized adaptor oligonucleotide
  misc_feature (34)..(36): n is a, c, g, or t
tgcaggaccagagaattcgaatacagagcagtannntgcatcaggt

SEQ ID NO: 7417 - DNA, 46 bp, Artificial Sequence
  Synthesized adaptor oligonucleotide
  misc_feature (34)..(36): n is a, c, g, or t
tgcaggaccagagaattcgaatacagcgtaagannntgcatcaggt

SEQ ID NO: 7418 - DNA, 46 bp, Artificial Sequence
  Synthesized adaptor oligonucleotide
  misc_feature (34)..(36): n is a, c, g, or t
tgcaggaccagagaattcgaatacatcgcaaacnnntgcatcaggt

SEQ ID NO: 7419 - DNA, 46 bp, Artificial Sequence
  Synthesized adaptor oligonucleotide
  misc_feature (34)..(36): n is a, c, g, or t
tgcaggaccagagaattcgaatacagaagcttcnnntgcatcaggt

SEQ ID NO: 7420 - DNA, 46 bp, Artificial Sequence
  Synthesized adaptor oligonucleotide
  misc_feature (34)..(36): n is a, c, g, or t
tgcaggaccagagaattcgaatacatattacctnnntgcatcaggt

SEQ ID NO: 7421 - DNA, 46 bp, Artificial Sequence
  Synthesized adaptor oligonucleotide
  misc_feature (34)..(36): n is a, c, g, or t
tgcaggaccagagaattcgaatacatgcatgtgnnntgcatcaggt

SEQ ID NO: 7422 - DNA, 46 bp, Artificial Sequence
  Synthesized adaptor oligonucleotide
  misc_feature (34)..(36): n is a, c, g, or t
tgcaggaccagagaattcgaatacagctttgagnnntgcatcaggt

SEQ ID NO: 7423 - DNA, 46 bp, Artificial Sequence
  Synthesized adaptor oligonucleotide
  misc_feature (34)..(36): n is a, c, g, or t
tgcaggaccagagaattcgaatacatcctattannntgcatcaggt

SEQ ID NO: 7424 - DNA, 46 bp, Artificial Sequence
  Synthesized adaptor oligonucleotide
  misc_feature (34)..(36): n is a, c, g, or t
tgcaggaccagagaattcgaatacacgtcaggcnnntgcatcaggt

SEQ ID NO: 7425 - DNA, 46 bp, Artificial Sequence
  Synthesized adaptor oligonucleotide
  misc_feature (34)..(36): n is a, c, g, or t
tgcaggaccagagaattcgaatacaccgcgatgnnntgcatcaggt

SEQ ID NO: 7426 - DNA, 46 bp, Artificial Sequence
  Synthesized adaptor oligonucleotide
  misc_feature (34)..(36): n is a, c, g, or t
tgcaggaccagagaattcgaatacaggttgtcannntgcatcaggt

SEQ ID NO: 7427 - DNA, 46 bp, Artificial Sequence
  Synthesized adaptor oligonucleotide
  misc_feature (34)..(36): n is a, c, g, or t
tgcaggaccagagaattcgaatacagcagcaaannntgcatcaggt

SEQ ID NO: 7428 - DNA, 46 bp, Artificial Sequence
  Synthesized adaptor oligonucleotide
  misc_feature (34)..(36): n is a, c, g, or t
tgcaggaccagagaattcgaatacagcgtaactnnntgcatcaggt

SEQ ID NO: 7429 - DNA, 46 bp, Artificial Sequence
  Synthesized adaptor oligonucleotide
  misc_feature (34)..(36): n is a, c, g, or t
tgcaggaccagagaattcgaatacagagagtcannntgcatcaggt

SEQ ID NO: 7430 - DNA, 46 bp, Artificial Sequence
  Synthesized adaptor oligonucleotide
  misc_feature (34)..(36): n is a, c, g, or t
tgcaggaccagagaattcgaatacactatgcctnnntgcatcaggt

SEQ ID NO: 7431 - DNA, 46 bp, Artificial Sequence
  Synthesized adaptor oligonucleotide
  misc_feature (34)..(36): n is a, c, g, or t
tgcaggaccagagaattcgaatacaaaccgaagnnntgcatcaggt

SEQ ID NO: 7432 - DNA, 46 bp, Artificial Sequence
  Synthesized adaptor oligonucleotide
  misc_feature (34)..(36): n is a, c, g, or t
tgcaggaccagagaattcgaatacacggcccggnnntgcatcaggt

SEQ ID NO: 7433 - DNA, 46 bp, Artificial Sequence
  Synthesized adaptor oligonucleotide
  misc_feature (34)..(36): n is a, c, g, or t
tgcaggaccagagaattcgaatacaaagcgcccnnntgcatcaggt

SEQ ID NO: 7434 - DNA, 46 bp, Artificial Sequence
  Synthesized adaptor oligonucleotide
  misc_feature (34)..(36): n is a, c, g, or t
tgcaggaccagagaattcgaatacaataaggatnnntgcatcaggt

SEQ ID NO: 7435 - DNA, 46 bp, Artificial Sequence
  Synthesized adaptor oligonucleotide
  misc_feature (34)..(36): n is a, c, g, or t
tgcaggaccagagaattcgaatacaagctgagannntgcatcaggt

SEQ ID NO: 7436 - DNA, 46 bp, Artificial Sequence
  Synthesized adaptor oligonucleotide
  misc_feature (34)..(36): n is a, c, g, or t
tgcaggaccagagaattcgaatacactctgactnnntgcatcaggt

SEQ ID NO: 7437 - DNA, 46 bp, Artificial Sequence
  Synthesized adaptor oligonucleotide
  misc_feature (34)..(36): n is a, c, g, or t
tgcaggaccagagaattcgaatacatcgcaggcnnntgcatcaggt

SEQ ID NO: 7438 - DNA, 46 bp, Artificial Sequence
  Synthesized adaptor oligonucleotide
  misc_feature (34)..(36): n is a, c, g, or t
tgcaggaccagagaattcgaatacaatattagcnnntgcatcaggt

SEQ ID NO: 7439 - DNA, 46 bp, Artificial Sequence
  Synthesized adaptor oligonucleotide
  misc_feature (34)..(36): n is a, c, g, or t
tgcaggaccagagaattcgaatacaaccgtatgnnntgcatcaggt

SEQ ID NO: 7440 - DNA, 46 bp, Artificial Sequence
  Synthesized adaptor oligonucleotide
  misc_feature (34)..(36): n is a, c, g, or t
tgcaggaccagagaattcgaatacaggtcggtcnnntgcatcaggt

SEQ ID NO: 7441 - DNA, 46 bp, Artificial Sequence
  Synthesized adaptor oligonucleotide
  misc_feature (34)..(36): n is a, c, g, or t
tgcaggaccagagaattcgaatacaatatcgtannntgcatcaggt

SEQ ID NO: 7442 - DNA, 46 bp, Artificial Sequence
  Synthesized adaptor oligonucleotide
  misc_feature (34)..(36): n is a, c, g, or t
tgcaggaccagagaattcgaatacaacctctcannntgcatcaggt

SEQ ID NO: 7443 - DNA, 46 bp, Artificial Sequence
  Synthesized adaptor oligonucleotide
  misc_feature (34)..(36): n is a, c, g, or t
tgcaggaccagagaattcgaatacagtcggtgcnnntgcatcaggt

SEQ ID NO: 7444 - DNA, 46 bp, Artificial Sequence
  Synthesized adaptor oligonucleotide
  misc_feature (34)..(36): n is a, c, g, or t
tgcaggaccagagaattcgaatacattcgcccgnnntgcatcaggt

SEQ ID NO: 7445 - DNA, 46 bp, Artificial Sequence
  Synthesized adaptor oligonucleotide
  misc_feature (34)..(36): n is a, c, g, or t
tgcaggaccagagaattcgaatacacaggctgcnnntgcatcaggt

SEQ ID NO: 7446 - DNA, 46 bp, Artificial Sequence
  Synthesized adaptor oligonucleotide
  misc_feature (34)..(36): n is a, c, g, or t
tgcaggaccagagaattcgaatacatcgcttacnnntgcatcaggt

SEQ ID NO: 7447 - DNA, 46 bp, Artificial Sequence
  Synthesized adaptor oligonucleotide
  misc_feature (34)..(36): n is a, c, g, or t
tgcaggaccagagaattcgaatacacggattgtnnntgcatcaggt

SEQ ID NO: 7448 - DNA, 46 bp, Artificial Sequence
  Synthesized adaptor oligonucleotide
  misc_feature (34)..(36): n is a, c, g, or t
tgcaggaccagagaattcgaatacacaagctgtnnntgcatcaggt

SEQ ID NO: 7449 - DNA, 46 bp, Artificial Sequence
  Synthesized adaptor oligonucleotide
  misc_feature (34)..(36): n is a, c, g, or t
tgcaggaccagagaattcgaatacattccaattnnnacgtatgcca

SEQ ID NO: 7450 - DNA, 46 bp, Artificial Sequence
  Synthesized adaptor oligonucleotide
  misc_feature (34)..(36): n is a, c, g, or t
tgcaggaccagagaattcgaatacatgtacagcnnnacgtatgcca

SEQ ID NO: 7451 - DNA, 46 bp, Artificial Sequence
  Synthesized adaptor oligonucleotide
  misc_feature (34)..(36): n is a, c, g, or t
tgcaggaccagagaattcgaatacacaggagcgnnnacgtatgcca

SEQ ID NO: 7452 - DNA, 46 bp, Artificial Sequence
  Synthesized adaptor oligonucleotide
  misc_feature (34)..(36): n is a, c, g, or t
tgcaggaccagagaattcgaatacaatgcgttgnnnacgtatgcca

SEQ ID NO: 7453 - DNA, 46 bp, Artificial Sequence
  Synthesized adaptor oligonucleotide
  misc_feature (34)..(36): n is a, c, g, or t
tgcaggaccagagaattcgaatacatattttcgnnnacgtatgcca

SEQ ID NO: 7454 - DNA, 46 bp, Artificial Sequence
  Synthesized adaptor oligonucleotide
  misc_feature (34)..(36): n is a, c, g, or t
tgcaggaccagagaattcgaatacaaattccccnnnacgtatgcca

SEQ ID NO: 7455 - DNA, 46 bp, Artificial Sequence
  Synthesized adaptor oligonucleotide
  misc_feature (34)..(36): n is a, c, g, or t
tgcaggaccagagaattcgaatacatctgacgannnacgtatgcca

SEQ ID NO: 7456 - DNA, 46 bp, Artificial Sequence
  Synthesized adaptor oligonucleotide
  misc_feature (34)..(36): n is a, c, g, or t
tgcaggaccagagaattcgaatacaccgcgcttnnnacgtatgcca

SEQ ID NO: 7457 - DNA, 46 bp, Artificial Sequence
  Synthesized adaptor oligonucleotide
  misc_feature (34)..(36): n is a, c, g, or t
tgcaggaccagagaattcgaatacaaaacacccnnnacgtatgcca

SEQ ID NO: 7458 - DNA, 46 bp, Artificial Sequence
  Synthesized adaptor oligonucleotide
  misc_feature (34)..(36): n is a, c, g, or t
tgcaggaccagagaattcgaatacaggttgtgtnnnacgtatgcca

SEQ ID NO: 7459 - DNA, 46 bp, Artificial Sequence
  Synthesized adaptor oligonucleotide
  misc_feature (34)..(36): n is a, c, g, or t
tgcaggaccagagaattcgaatacaactaaccgnnnacgtatgcca

SEQ ID NO: 7460 - DNA, 46 bp, Artificial Sequence
  Synthesized adaptor oligonucleotide
  misc_feature (34)..(36): n is a, c, g, or t
tgcaggaccagagaattcgaatacatcaggagannnacgtatgcca

SEQ ID NO: 7461 - DNA, 46 bp, Artificial Sequence
  Synthesized adaptor oligonucleotide
  misc_feature (34)..(36): n is a, c, g, or t
tgcaggaccagagaattcgaatacagtctgcggnnnacgtatgcca

SEQ ID NO: 7462 - DNA, 46 bp, Artificial Sequence
  Synthesized adaptor oligonucleotide
  misc_feature (34)..(36): n is a, c, g, or t
tgcaggaccagagaattcgaatacaactggcgcnnnacgtatgcca

SEQ ID NO: 7463 - DNA, 46 bp, Artificial Sequence
  Synthesized adaptor oligonucleotide
  misc_feature (34)..(36): n is a, c, g, or t
tgcaggaccagagaattcgaatacacgactcttnnnacgtatgcca

SEQ ID NO: 7464 - DNA, 46 bp, Artificial Sequence
  Synthesized adaptor oligonucleotide
  misc_feature (34)..(36): n is a, c, g, or t
tgcaggaccagagaattcgaatacagcgaaggcnnnacgtatgcca

SEQ ID NO: 7465 - DNA, 46 bp, Artificial Sequence
  Synthesized adaptor oligonucleotide
  misc_feature (34)..(36): n is a, c, g, or t
tgcaggaccagagaattcgaatacaggcgccgcnnnacgtatgcca

SEQ ID NO: 7466 - DNA, 46 bp, Artificial Sequence
  Synthesized adaptor oligonucleotide
  misc_feature (34)..(36): n is a, c, g, or t
tgcaggaccagagaattcgaatacagagcacccnnnacgtatgcca

SEQ ID NO: 7467 - DNA, 46 bp, Artificial Sequence
  Synthesized adaptor oligonucleotide
  misc_feature (34)..(36): n is a, c, g, or t
tgcaggaccagagaattcgaatacacccaaagtnnnacgtatgcca

SEQ ID NO: 7468 - DNA, 46 bp, Artificial Sequence
  Synthesized adaptor oligonucleotide
  misc_feature (34)..(36): n is a, c, g, or t
tgcaggaccagagaattcgaatacacggaatagnnnacgtatgcca

SEQ ID NO: 7469 - DNA, 46 bp, Artificial Sequence
  Synthesized adaptor oligonucleotide
  misc_feature (34)..(36): n is a, c, g, or t
tgcaggaccagagaattcgaatacaagtaagatnnnacgtatgcca

SEQ ID NO: 7470 - DNA, 46 bp, Artificial Sequence
  Synthesized adaptor oligonucleotide
  misc_feature (34)..(36): n is a, c, g, or t
tgcaggaccagagaattcgaatacatctcacacnnnacgtatgcca

SEQ ID NO: 7471 - DNA, 46 bp, Artificial Sequence
  Synthesized adaptor oligonucleotide
  misc_feature (34)..(36): n is a, c, g, or t
tgcaggaccagagaattcgaatacaggccccaannnacgtatgcca

SEQ ID NO: 7472 - DNA, 46 bp, Artificial Sequence
  Synthesized adaptor oligonucleotide
  misc_feature (34)..(36): n is a, c, g, or t
tgcaggaccagagaattcgaatacaggatttgcnnnacgtatgcca

SEQ ID NO: 7473 - DNA, 46 bp, Artificial Sequence
  Synthesized adaptor oligonucleotide
  misc_feature (34)..(36): n is a, c, g, or t
tgcaggaccagagaattcgaatacaaatgacaannnacgtatgcca

SEQ ID NO: 7474 - DNA, 46 bp, Artificial Sequence
  Synthesized adaptor oligonucleotide
  misc_feature (34)..(36): n is a, c, g, or t
tgcaggaccagagaattcgaatacataaaaaatnnnacgtatgcca

SEQ ID NO: 7475 - DNA, 46 bp, Artificial Sequence
  Synthesized adaptor oligonucleotide
  misc_feature (34)..(36): n is a, c, g, or t
tgcaggaccagagaattcgaatacataatggccnnnacgtatgcca

SEQ ID NO: 7476 - DNA, 46 bp, Artificial Sequence
  Synthesized adaptor oligonucleotide
  misc_feature (34)..(36): n is a, c, g, or t
tgcaggaccagagaattcgaatacagttgcttcnnnacgtatgcca

SEQ ID NO: 7477 - DNA, 46 bp, Artificial Sequence
  Synthesized adaptor oligonucleotide
  misc_feature (34)..(36): n is a, c, g, or t
tgcaggaccagagaattcgaatacacgtttcacnnnacgtatgcca

SEQ ID NO: 7478 - DNA, 46 bp, Artificial Sequence
  Synthesized adaptor oligonucleotide
  misc_feature (34)..(36): n is a, c, g, or t
tgcaggaccagagaattcgaatacagaacaaatnnnacgtatgcca

SEQ ID NO: 7479 - DNA, 46 bp, Artificial Sequence
  Synthesized adaptor oligonucleotide
  misc_feature (34)..(36): n is a, c, g, or t
tgcaggaccagagaattcgaatacaatagaagtnnnacgtatgcca

SEQ ID NO: 7480 - DNA, 46 bp, Artificial Sequence
  Synthesized adaptor oligonucleotide
  misc_feature (34)..(36): n is a, c, g, or t
tgcaggaccagagaattcgaatacagtaaggcannnacgtatgcca

SEQ ID NO: 7481 - DNA, 46 bp, Artificial Sequence
  Synthesized adaptor oligonucleotide
  misc_feature (34)..(36): n is a, c, g, or t
tgcaggaccagagaattcgaatacagagatgcannnacgtatgcca

SEQ ID NO: 7482 - DNA, 46 bp, Artificial Sequence
  Synthesized adaptor oligonucleotide
  misc_feature (34)..(36): n is a, c, g, or t
tgcaggaccagagaattcgaatacacaccatctnnnacgtatgcca

SEQ ID NO: 7483 - DNA, 46 bp, Artificial Sequence
  Synthesized adaptor oligonucleotide
  misc_feature (34)..(36): n is a, c, g, or t
tgcaggaccagagaattcgaatacagatacaccnnnacgtatgcca

SEQ ID NO: 7484 - DNA, 46 bp, Artificial Sequence
  Synthesized adaptor oligonucleotide
  misc_feature (34)..(36): n is a, c, g, or t
tgcaggaccagagaattcgaatacagatactgcnnnacgtatgcca

SEQ ID NO: 7485 - DNA, 46 bp, Artificial Sequence
  Synthesized adaptor oligonucleotide
  misc_feature (34)..(36): n is a, c, g, or t
tgcaggaccagagaattcgaatacacgtaactgnnnacgtatgcca

SEQ ID NO: 7486 - DNA, 46 bp, Artificial Sequence
  Synthesized adaptor oligonucleotide
  misc_feature (34)..(36): n is a, c, g, or t
tgcaggaccagagaattcgaatacatcctcttcnnnacgtatgcca

SEQ ID NO: 7487 - DNA, 46 bp, Artificial Sequence
  Synthesized adaptor oligonucleotide
  misc_feature (34)..(36): n is a, c, g, or t
tgcaggaccagagaattcgaatacatgcggtcgnnnacgtatgcca

SEQ ID NO: 7488 - DNA, 46 bp, Artificial Sequence
  Synthesized adaptor oligonucleotide
  misc_feature (34)..(36): n is a, c, g, or t
tgcaggaccagagaattcgaatacaacaggaacnnnacgtatgcca

SEQ ID NO: 7489 - DNA, 46 bp, Artificial Sequence
  Synthesized adaptor oligonucleotide
  misc_feature (34)..(36): n is a, c, g, or t
tgcaggaccagagaattcgaatacaaaaattttnnnacgtatgcca

SEQ ID NO: 7490 - DNA, 46 bp, Artificial Sequence
  Synthesized adaptor oligonucleotide
  misc_feature (34)..(36): n is a, c, g, or t
tgcaggaccagagaattcgaatacaaagtcaccnnnacgtatgcca

SEQ ID NO: 7491 - DNA, 46 bp, Artificial Sequence
  Synthesized adaptor oligonucleotide
  misc_feature (34)..(36): n is a, c, g, or t
tgcaggaccagagaattcgaatacatctacgagnnnacgtatgcca

SEQ ID NO: 7492 - DNA, 46 bp, Artificial Sequence
  Synthesized adaptor oligonucleotide
  misc_feature (34)..(36): n is a, c, g, or t
tgcaggaccagagaattcgaatacagatcttccnnnacgtatgcca

SEQ ID NO: 7493 - DNA, 46 bp, Artificial Sequence
  Synthesized adaptor oligonucleotide
  misc_feature (34)..(36): n is a, c, g, or t
tgcaggaccagagaattcgaatacaggacacccnnnacgtatgcca

SEQ ID NO: 7494 - DNA, 46 bp, Artificial Sequence
  Synthesized adaptor oligonucleotide
  misc_feature (34)..(36): n is a, c, g, or t
tgcaggaccagagaattcgaatacaataggtggnnnacgtatgcca

SEQ ID NO: 7495 - DNA, 46 bp, Artificial Sequence
  Synthesized adaptor oligonucleotide
  misc_feature (34)..(36): n is a, c, g, or t
tgcaggaccagagaattcgaatacaccatcgccnnnacgtatgcca

SEQ ID NO: 7496 - DNA, 46 bp, Artificial Sequence
  Synthesized adaptor oligonucleotide
  misc_feature (34)..(36): n is a, c, g, or t
tgcaggaccagagaattcgaatacatgatctccnnnacgtatgcca

SEQ ID NO: 7497 - DNA, 46 bp, Artificial Sequence
  Synthesized adaptor oligonucleotide
  misc_feature (34)..(36): n is a, c, g, or t
tgcaggaccagagaattcgaatacacgcgaattnnnacgtatgcca

SEQ ID NO: 7498 - DNA, 46 bp, Artificial Sequence
  Synthesized adaptor oligonucleotide
  misc_feature (34)..(36): n is a, c, g, or t
tgcaggaccagagaattcgaatacatatataatnnnacgtatgcca

SEQ ID NO: 7499 - DNA, 46 bp, Artificial Sequence
  Synthesized adaptor oligonucleotide
  misc_feature (34)..(36): n is a, c, g, or t
tgcaggaccagagaattcgaatacatatcgcctnnnacgtatgcca

SEQ ID NO: 7500 - DNA, 46 bp, Artificial Sequence
  Synthesized adaptor oligonucleotide
  misc_feature (34)..(36): n is a, c, g, or t
tgcaggaccagagaattcgaatacattacgagcnnnacgtatgcca

SEQ ID NO: 7501 - DNA, 46 bp, Artificial Sequence
  Synthesized adaptor oligonucleotide
  misc_feature (34)..(36): n is a, c, g, or t
tgcaggaccagagaattcgaatacaggtttctcnnnacgtatgcca

SEQ ID NO: 7502 - DNA, 46 bp, Artificial Sequence
  Synthesized adaptor oligonucleotide
  misc_feature (34)..(36): n is a, c, g, or t
tgcaggaccagagaattcgaatacacttgcagannnacgtatgcca

SEQ ID NO: 7503 - DNA, 46 bp, Artificial Sequence
  Synthesized adaptor oligonucleotide
  misc_feature (34)..(36): n is a, c, g, or t
tgcaggaccagagaattcgaatacagacatttannnacgtatgcca

SEQ ID NO: 7504 - DNA, 46 bp, Artificial Sequence
  Synthesized adaptor oligonucleotide
  misc_feature (34)..(36): n is a, c, g, or t
tgcaggaccagagaattcgaatacaacacgagannnacgtatgcca

SEQ ID NO: 7505 - DNA, 46 bp, Artificial Sequence
  Synthesized adaptor oligonucleotide
  misc_feature (34)..(36): n is a, c, g, or t
tgcaggaccagagaattcgaatacattgcccgcnnnacgtatgcca

SEQ ID NO: 7506 - DNA, 46 bp, Artificial Sequence
  Synthesized adaptor oligonucleotide
  misc_feature (34)..(36): n is a, c, g, or t
tgcaggaccagagaattcgaatacacagtccttnnnacgtatgcca

SEQ ID NO: 7507 - DNA, 46 bp, Artificial Sequence
  Synthesized adaptor oligonucleotide
  misc_feature (34)..(36): n is a, c, g, or t
tgcaggaccagagaattcgaatacagcatttggnnnacgtatgcca

SEQ ID NO: 7508 - DNA, 46 bp, Artificial Sequence
  Synthesized adaptor oligonucleotide
  misc_feature (34)..(36): n is a, c, g, or t
tgcaggaccagagaattcgaatacaggatatccnnnacgtatgcca

SEQ ID NO: 7509 - DNA, 46 bp, Artificial Sequence
  Synthesized adaptor oligonucleotide
  misc_feature (34)..(36): n is a, c, g, or t
tgcaggaccagagaattcgaatacaccaggaggnnnctagcgttac

SEQ ID NO: 7510 - DNA, 46 bp, Artificial Sequence
  Synthesized adaptor oligonucleotide
  misc_feature (34)..(36): n is a, c, g, or t
tgcaggaccagagaattcgaatacatcgccttannnctagcgttac

SEQ ID NO: 7511 - DNA, 46 bp, Artificial Sequence
  Synthesized adaptor oligonucleotide
  misc_feature (34)..(36): n is a, c, g, or t
tgcaggaccagagaattcgaatacattacccgtnnnctagcgttac

SEQ ID NO: 7512 - DNA, 46 bp, Artificial Sequence
  Synthesized adaptor oligonucleotide
  misc_feature (34)..(36): n is a, c, g, or t
tgcaggaccagagaattcgaatacaatcacctcnnnctagcgttac

SEQ ID NO: 7513 - DNA, 46 bp, Artificial Sequence
  Synthesized adaptor oligonucleotide
  misc_feature (34)..(36): n is a, c, g, or t
tgcaggaccagagaattcgaatacaccaattccnnnctagcgttac

SEQ ID NO: 7514 - DNA, 46 bp, Artificial Sequence
  Synthesized adaptor oligonucleotide
  misc_feature (34)..(36): n is a, c, g, or t
tgcaggaccagagaattcgaatacatgcgtgatnnnctagcgttac

SEQ ID NO: 7515 - DNA, 46 bp, Artificial Sequence
  Synthesized adaptor oligonucleotide
  misc_feature (34)..(36): n is a, c, g, or t
tgcaggaccagagaattcgaatacactcggcctnnnctagcgttac

SEQ ID NO: 7516 - DNA, 46 bp, Artificial Sequence
  Synthesized adaptor oligonucleotide
  misc_feature (34)..(36): n is a, c, g, or t
tgcaggaccagagaattcgaatacaaggaattannnctagcgttac

SEQ ID NO: 7517 - DNA, 46 bp, Artificial Sequence
  Synthesized adaptor oligonucleotide
  misc_feature (34)..(36): n is a, c, g, or t
tgcaggaccagagaattcgaatacaccctacatnnnctagcgttac

SEQ ID NO: 7518 - DNA, 46 bp, Artificial Sequence
  Synthesized adaptor oligonucleotide
  misc_feature (34)..(36): n is a, c, g, or t
tgcaggaccagagaattcgaatacacggtttagnnnctagcgttac

SEQ ID NO: 7519 - DNA, 46 bp, Artificial Sequence
  Synthesized adaptor oligonucleotide
  misc_feature (34)..(36): n is a, c, g, or t
tgcaggaccagagaattcgaatacatcgtataannnctagcgttac

SEQ ID NO: 7520 - DNA, 46 bp, Artificial Sequence
  Synthesized adaptor oligonucleotide
  misc_feature (34)..(36): n is a, c, g, or t
tgcaggaccagagaattcgaatacataagcaaannnctagcgttac

SEQ ID NO: 7521 - DNA, 46 bp, Artificial Sequence
  Synthesized adaptor oligonucleotide
  misc_feature (34)..(36): n is a, c, g, or t
tgcaggaccagagaattcgaatacacggtctggnnnctagcgttac

SEQ ID NO: 7522 - DNA, 46 bp, Artificial Sequence
  Synthesized adaptor oligonucleotide
  misc_feature (34)..(36): n is a, c, g, or t
tgcaggaccagagaattcgaatacaccacagtannnctagcgttac

SEQ ID NO: 7523 - DNA, 46 bp, Artificial Sequence
  Synthesized adaptor oligonucleotide
  misc_feature (34)..(36): n is a, c, g, or t
tgcaggaccagagaattcgaatacaaccactagnnnctagcgttac

SEQ ID NO: 7524 - DNA, 46 bp, Artificial Sequence
  Synthesized adaptor oligonucleotide
  misc_feature (34)..(36): n is a, c, g, or t
tgcaggaccagagaattcgaatacacgcaaactnnnctagcgttac

SEQ ID NO: 7525 - DNA, 46 bp, Artificial Sequence
  Synthesized adaptor oligonucleotide
  misc_feature (34)..(36): n is a, c, g, or t
tgcaggaccagagaattcgaatacacttcaaccnnnctagcgttac

SEQ ID NO: 7526 - DNA, 46 bp, Artificial Sequence
  Synthesized adaptor oligonucleotide
  misc_feature (34)..(36): n is a, c, g, or t
tgcaggaccagagaattcgaatacagagaggccnnnctagcgttac

SEQ ID NO: 7527 - DNA, 46 bp, Artificial Sequence
  Synthesized adaptor oligonucleotide
  misc_feature (34)..(36): n is a, c, g, or t
tgcaggaccagagaattcgaatacaatattggtnnnctagcgttac

SEQ ID NO: 7528 - DNA, 46 bp, Artificial Sequence
  Synthesized adaptor oligonucleotide
  misc_feature (34)..(36): n is a, c, g, or t
tgcaggaccagagaattcgaatacactatatgannnctagcgttac

SEQ ID NO: 7529 - DNA, 46 bp, Artificial Sequence
  Synthesized adaptor oligonucleotide
  misc_feature (34)..(36): n is a, c, g, or t
tgcaggaccagagaattcgaatacaatcttgttnnnctagcgttac

SEQ ID NO: 7530 - DNA, 46 bp, Artificial Sequence
  Synthesized adaptor oligonucleotide
  misc_feature (34)..(36): n is a, c, g, or t
tgcaggaccagagaattcgaatacataaaggcgnnnctagcgttac

SEQ ID NO: 7531 - DNA, 46 bp, Artificial Sequence
  Synthesized adaptor oligonucleotide
  misc_feature (34)..(36): n is a, c, g, or t
tgcaggaccagagaattcgaatacaccatttgcnnnctagcgttac

SEQ ID NO: 7532 - DNA, 46 bp, Artificial Sequence
  Synthesized adaptor oligonucleotide
  misc_feature (34)..(36): n is a, c, g, or t
tgcaggaccagagaattcgaatacatacccctannnctagcgttac

SEQ ID NO: 7533 - DNA, 46 bp, Artificial Sequence
  Synthesized adaptor oligonucleotide
  misc_feature (34)..(36): n is a, c, g, or t
tgcaggaccagagaattcgaatacaagaaccgannnctagcgttac

SEQ ID NO: 7534 - DNA, 46 bp, Artificial Sequence
  Synthesized adaptor oligonucleotide
  misc_feature (34)..(36): n is a, c, g, or t
tgcaggaccagagaattcgaatacaacgataggnnnctagcgttac

SEQ ID NO: 7535 - DNA, 46 bp, Artificial Sequence
  Synthesized adaptor oligonucleotide
  misc_feature (34)..(36): n is a, c, g, or t
tgcaggaccagagaattcgaatacaggcgccatnnnctagcgttac

SEQ ID NO: 7536 - DNA, 46 bp, Artificial Sequence
  Synthesized adaptor oligonucleotide
  misc_feature (34)..(36): n is a, c, g, or t
tgcaggaccagagaattcgaatacaaaaatctcnnnctagcgttac

SEQ ID NO: 7537 - DNA, 46 bp, Artificial Sequence
  Synthesized adaptor oligonucleotide
  misc_feature (34)..(36): n is a, c, g, or t
tgcaggaccagagaattcgaatacagactagctnnnctagcgttac

SEQ ID NO: 7538 - DNA, 46 bp, Artificial Sequence
  Synthesized adaptor oligonucleotide
  misc_feature (34)..(36): n is a, c, g, or t
tgcaggaccagagaattcgaatacacgtgagttnnnctagcgttac

SEQ ID NO: 7539 - DNA, 46 bp, Artificial Sequence
  Synthesized adaptor oligonucleotide
  misc_feature (34)..(36): n is a, c, g, or t
tgcaggaccagagaattcgaatacacccgctgtnnnctagcgttac

SEQ ID NO: 7540 - DNA, 46 bp, Artificial Sequence
  Synthesized adaptor oligonucleotide
  misc_feature (34)..(36): n is a, c, g, or t
tgcaggaccagagaattcgaatacaaaaacttcnnnctagcgttac

SEQ ID NO: 7541 - DNA, 46 bp, Artificial Sequence
  Synthesized adaptor oligonucleotide
  misc_feature (34)..(36): n is a, c, g, or t
tgcaggaccagagaattcgaatacaagtaacggnnnctagcgttac

SEQ ID NO: 7542 - DNA, 46 bp, Artificial Sequence
  Synthesized adaptor oligonucleotide
  misc_feature (34)..(36): n is a, c, g, or t
tgcaggaccagagaattcgaatacaatcaacatnnnctagcgttac

SEQ ID NO: 7543 - DNA, 46 bp, Artificial Sequence
  Synthesized adaptor oligonucleotide
  misc_feature (34)..(36): n is a, c, g, or t
tgcaggaccagagaattcgaatacacttttgatnnnctagcgttac

SEQ ID NO: 7544 - DNA, 46 bp, Artificial Sequence
  Synthesized adaptor oligonucleotide
  misc_feature (34)..(36): n is a, c, g, or t
tgcaggaccagagaattcgaatacagtgtaccannnctagcgttac

SEQ ID NO: 7545 - DNA, 46 bp, Artificial Sequence
  Synthesized adaptor oligonucleotide
  misc_feature (34)..(36): n is a, c, g, or t
tgcaggaccagagaattcgaatacatgcacacannnctagcgttac

SEQ ID NO: 7546 - DNA, 46 bp, Artificial Sequence
  Synthesized adaptor oligonucleotide
  misc_feature (34)..(36): n is a, c, g, or t
tgcaggaccagagaattcgaatacatatacttcnnnctagcgttac

SEQ ID NO: 7547 - DNA, 46 bp, Artificial Sequence
  Synthesized adaptor oligonucleotide
  misc_feature (34)..(36): n is a, c, g, or t
tgcaggaccagagaattcgaatacagaaactaannnctagcgttac

SEQ ID NO: 7548 - DNA, 46 bp, Artificial Sequence
  Synthesized adaptor oligonucleotide
  misc_feature (34)..(36): n is a, c, g, or t
tgcaggaccagagaattcgaatacaatctcgagnnnctagcgttac

SEQ ID NO: 7549 - DNA, 46 bp, Artificial Sequence
  Synthesized adaptor oligonucleotide
  misc_feature (34)..(36): n is a, c, g, or t
tgcaggaccagagaattcgaatacaatgtctggnnnctagcgttac

SEQ ID NO: 7550 - DNA, 46 bp, Artificial Sequence
  Synthesized adaptor oligonucleotide
  misc_feature (34)..(36): n is a, c, g, or t
tgcaggaccagagaattcgaatacaagacatggnnnctagcgttac

SEQ ID NO: 7551 - DNA, 46 bp, Artificial Sequence
  Synthesized adaptor oligonucleotide
  misc_feature (34)..(36): n is a, c, g, or t
tgcaggaccagagaattcgaatacacggcaattnnnctagcgttac

SEQ ID NO: 7552 - DNA, 46 bp, Artificial Sequence
  Synthesized adaptor oligonucleotide
  misc_feature (34)..(36): n is a, c, g, or t
tgcaggaccagagaattcgaatacataatgttgnnnctagcgttac

SEQ ID NO: 7553 - DNA, 46 bp, Artificial Sequence
  Synthesized adaptor oligonucleotide
  misc_feature (34)..(36): n is a, c, g, or t
tgcaggaccagagaattcgaatacagcgaggacnnnctagcgttac

SEQ ID NO: 7554 - DNA, 46 bp, Artificial Sequence
  Synthesized adaptor oligonucleotide
  misc_feature (34)..(36): n is a, c, g, or t
tgcaggaccagagaattcgaatacacgaacatcnnnctagcgttac

SEQ ID NO: 7555 - DNA, 46 bp, Artificial Sequence
  Synthesized adaptor oligonucleotide
  misc_feature (34)..(36): n is a, c, g, or t
tgcaggaccagagaattcgaatacagcatgtacnnnctagcgttac

SEQ ID NO: 7556 - DNA, 46 bp, Artificial Sequence
  Synthesized adaptor oligonucleotide
  misc_feature (34)..(36): n is a, c, g, or t
tgcaggaccagagaattcgaatacagcaactgtnnnctagcgttac

SEQ ID NO: 7557 - DNA, 46 bp, Artificial Sequence
  Synthesized adaptor oligonucleotide
  misc_feature (34)..(36): n is a, c, g, or t
tgcaggaccagagaattcgaatacagtactctcnnnctagcgttac

SEQ ID NO: 7558 - DNA, 46 bp, Artificial Sequence
  Synthesized adaptor oligonucleotide
  misc_feature (34)..(36): n is a, c, g, or t
tgcaggaccagagaattcgaatacaggctaaagnnnctagcgttac

SEQ ID NO: 7559 - DNA, 46 bp, Artificial Sequence
  Synthesized adaptor oligonucleotide
  misc_feature (34)..(36): n is a, c, g, or t
tgcaggaccagagaattcgaatacaccctttgannnctagcgttac

SEQ ID NO: 7560 - DNA, 46 bp, Artificial Sequence
  Synthesized adaptor oligonucleotide
  misc_feature (34)..(36): n is a, c, g, or t
tgcaggaccagagaattcgaatacacgcaggagnnnctagcgttac

SEQ ID NO: 7561 - DNA, 46 bp, Artificial Sequence
  Synthesized adaptor oligonucleotide
  misc_feature (34)..(36): n is a, c, g, or t
tgcaggaccagagaattcgaatacagtaagaatnnnctagcgttac

SEQ ID NO: 7562 - DNA, 46 bp, Artificial Sequence
  Synthesized adaptor oligonucleotide
  misc_feature (34)..(36): n is a, c, g, or t
tgcaggaccagagaattcgaatacatgattacannnctagcgttac

SEQ ID NO: 7563 - DNA, 46 bp, Artificial Sequence
  Synthesized adaptor oligonucleotide
  misc_feature (34)..(36): n is a, c, g, or t
tgcaggaccagagaattcgaatacacaaaaatgnnnctagcgttac

SEQ ID NO: 7564 - DNA, 46 bp, Artificial Sequence
  Synthesized adaptor oligonucleotide
  misc_feature (34)..(36): n is a, c, g, or t
tgcaggaccagagaattcgaatacaccgtggtgnnnctagcgttac

SEQ ID NO: 7565 - DNA, 46 bp, Artificial Sequence
  Synthesized adaptor oligonucleotide
  misc_feature (34)..(36): n is a, c, g, or t
tgcaggaccagagaattcgaatacaaacgttatnnnctagcgttac

SEQ ID NO: 7566 - DNA, 46 bp, Artificial Sequence
  Synthesized adaptor oligonucleotide
  misc_feature (34)..(36): n is a, c, g, or t
tgcaggaccagagaattcgaatacagcttgcaannnctagcgttac

SEQ ID NO: 7567 - DNA, 46 bp, Artificial Sequence
  Synthesized adaptor oligonucleotide
  misc_feature (34)..(36): n is a, c, g, or t
tgcaggaccagagaattcgaatacattagtcggnnnctagcgttac

SEQ ID NO: 7568 - DNA, 46 bp, Artificial Sequence
  Synthesized adaptor oligonucleotide
  misc_feature (34)..(36): n is a, c, g, or t
tgcaggaccagagaattcgaatacaacggccgtnnnctagcgttac

SEQ ID NO: 7569 - DNA, 46 bp, Artificial Sequence
  Synthesized adaptor oligonucleotide
  misc_feature (34)..(36): n is a, c, g, or t
tgcaggaccagagaattcgaatacagcgtgaaannngatcgacatg

SEQ ID NO: 7570 - DNA, 46 bp, Artificial Sequence
  Synthesized adaptor oligonucleotide
  misc_feature (34)..(36): n is a, c, g, or t
tgcaggaccagagaattcgaatacatgcctgccnnngatcgacatg

SEQ ID NO: 7571 - DNA, 46 bp, Artificial Sequence
  Synthesized adaptor oligonucleotide
  misc_feature (34)..(36): n is a, c, g, or t
tgcaggaccagagaattcgaatacatcgacgcgnnngatcgacatg

SEQ ID NO: 7572 - DNA, 46 bp, Artificial Sequence
  Synthesized adaptor oligonucleotide
  misc_feature (34)..(36): n is a, c, g, or t
tgcaggaccagagaattcgaatacatcatcctgnnngatcgacatg

SEQ ID NO: 7573 - DNA, 46 bp, Artificial Sequence
  Synthesized adaptor oligonucleotide
  misc_feature (34)..(36): n is a, c, g, or t
tgcaggaccagagaattcgaatacagtcagtcannngatcgacatg

SEQ ID NO: 7574 - DNA, 46 bp, Artificial Sequence
  Synthesized adaptor oligonucleotide
  misc_feature (34)..(36): n is a, c, g, or t
tgcaggaccagagaattcgaatacaccggtgacnnngatcgacatg

SEQ ID NO: 7575 - DNA, 46 bp, Artificial Sequence
  Synthesized adaptor oligonucleotide
  misc_feature (34)..(36): n is a, c, g, or t
tgcaggaccagagaattcgaatacatatcgcgannngatcgacatg

SEQ ID NO: 7576 - DNA, 46 bp, Artificial Sequence
  Synthesized adaptor oligonucleotide
  misc_feature (34)..(36): n is a, c, g, or t
tgcaggaccagagaattcgaatacagacgcgtcnnngatcgacatg

SEQ ID NO: 7577 - DNA, 46 bp, Artificial Sequence
  Synthesized adaptor oligonucleotide
  misc_feature (34)..(36): n is a, c, g, or t
tgcaggaccagagaattcgaatacagaacagacnnngatcgacatg

SEQ ID NO: 7578 - DNA, 46 bp, Artificial Sequence
  Synthesized adaptor oligonucleotide
  misc_feature (34)..(36): n is a, c, g, or t
tgcaggaccagagaattcgaatacagtgtgtgtnnngatcgacatg

SEQ ID NO: 7579 - DNA, 46 bp, Artificial Sequence
  Synthesized adaptor oligonucleotide
  misc_feature (34)..(36): n is a, c, g, or t
tgcaggaccagagaattcgaatacagattgcgtnnngatcgacatg

SEQ ID NO: 7580 - DNA, 46 bp, Artificial Sequence
  Synthesized adaptor oligonucleotide
  misc_feature (34)..(36): n is a, c, g, or t
tgcaggaccagagaattcgaatacagtagatttnnngatcgacatg

SEQ ID NO: 7581 - DNA, 46 bp, Artificial Sequence
  Synthesized adaptor oligonucleotide
  misc_feature (34)..(36): n is a, c, g, or t
tgcaggaccagagaattcgaatacagcttgagtnnngatcgacatg

SEQ ID NO: 7582 - DNA, 46 bp, Artificial Sequence
  Synthesized adaptor oligonucleotide
  misc_feature (34)..(36): n is a, c, g, or t
tgcaggaccagagaattcgaatacacgcaacgcnnngatcgacatg

SEQ ID NO: 7583 - DNA, 46 bp, Artificial Sequence
  Synthesized adaptor oligonucleotide
  misc_feature (34)..(36): n is a, c, g, or t
tgcaggaccagagaattcgaatacacctaatggnnngatcgacatg

SEQ ID NO: 7584 - DNA, 46 bp, Artificial Sequence
  Synthesized adaptor oligonucleotide
  misc_feature (34)..(36): n is a, c, g, or t
tgcaggaccagagaattcgaatacagacaggatnnngatcgacatg

SEQ ID NO: 7585 - DNA, 46 bp, Artificial Sequence
  Synthesized adaptor oligonucleotide
  misc_feature (34)..(36): n is a, c, g, or t
tgcaggaccagagaattcgaatacacttcccttnnngatcgacatg

SEQ ID NO: 7586 - DNA, 46 bp, Artificial Sequence
  Synthesized adaptor oligonucleotide
  misc_feature (34)..(36): n is a, c, g, or t
tgcaggaccagagaattcgaatacataagagatnnngatcgacatg

SEQ ID NO: 7587 - DNA, 46 bp, Artificial Sequence
  Synthesized adaptor oligonucleotide
  misc_feature (34)..(36): n is a, c, g, or t
tgcaggaccagagaattcgaatacaaccgaatcnnngatcgacatg

SEQ ID NO: 7588 - DNA, 46 bp, Artificial Sequence
  Synthesized adaptor oligonucleotide
  misc_feature (34)..(36): n is a, c, g, or t
tgcaggaccagagaattcgaatacagccaacatnnngatcgacatg

SEQ ID NO: 7589 - DNA, 46 bp, Artificial Sequence
  Synthesized adaptor oligonucleotide
  misc_feature (34)..(36): n is a, c, g, or t
tgcaggaccagagaattcgaatacatggctaacnnngatcgacatg

SEQ ID NO: 7590 - DNA, 46 bp, Artificial Sequence
  Synthesized adaptor oligonucleotide
  misc_feature (34)..(36): n is a, c, g, or t
tgcaggaccagagaattcgaatacatcgttcgtnnngatcgacatg

SEQ ID NO: 7591 - DNA, 46 bp, Artificial Sequence
  Synthesized adaptor oligonucleotide
  misc_feature (34)..(36): n is a, c, g, or t
tgcaggaccagagaattcgaatacacagttgcannngatcgacatg

SEQ ID NO: 7592 - DNA, 46 bp, Artificial Sequence
  Synthesized adaptor oligonucleotide
  misc_feature (34)..(36): n is a, c, g, or t
tgcaggaccagagaattcgaatacaactagctgnnngatcgacatg

SEQ ID NO: 7593 - DNA, 46 bp, Artificial Sequence
  Synthesized adaptor oligonucleotide
  misc_feature (34)..(36): n is a, c, g, or t
tgcaggaccagagaattcgaatacaaaactaagnnngatcgacatg

SEQ ID NO: 7594 - DNA, 46 bp, Artificial Sequence
  Synthesized adaptor oligonucleotide
  misc_feature (34)..(36): n is a, c, g, or t
tgcaggaccagagaattcgaatacagtttcgagnnngatcgacatg

SEQ ID NO: 7595 - DNA, 46 bp, Artificial Sequence
  Synthesized adaptor oligonucleotide
  misc_feature (34)..(36): n is a, c, g, or t
tgcaggaccagagaattcgaatacactcataggnnngatcgacatg

SEQ ID NO: 7596 - DNA, 46 bp, Artificial Sequence
  Synthesized adaptor oligonucleotide
  misc_feature (34)..(36): n is a, c, g, or t
tgcaggaccagagaattcgaatacagcagtatcnnngatcgacatg

SEQ ID NO: 7597 - DNA, 46 bp, Artificial Sequence
  Synthesized adaptor oligonucleotide
  misc_feature (34)..(36): n is a, c, g, or t
tgcaggaccagagaattcgaatacatatagtcannngatcgacatg

SEQ ID NO: 7598 - DNA, 46 bp, Artificial Sequence
  Synthesized adaptor oligonucleotide
  misc_feature (34)..(36): n is a, c, g, or t
tgcaggaccagagaattcgaatacaggtgtaagnnngatcgacatg

SEQ ID NO: 7599 - DNA, 46 bp, Artificial Sequence
  Synthesized adaptor oligonucleotide
  misc_feature (34)..(36): n is a, c, g, or t
tgcaggaccagagaattcgaatacaagtgaaatnnngatcgacatg

SEQ ID NO: 7600 - DNA, 46 bp, Artificial Sequence
  Synthesized adaptor oligonucleotide
  misc_feature (34)..(36): n is a, c, g, or t
tgcaggaccagagaattcgaatacaggtcgttannngatcgacatg

SEQ ID NO: 7601 - DNA, 46 bp, Artificial Sequence
  Synthesized adaptor oligonucleotide
  misc_feature (34)..(36): n is a, c, g, or t
tgcaggaccagagaattcgaatacatcgcgcctnnngatcgacatg

SEQ ID NO: 7602 - DNA, 46 bp, Artificial Sequence
  Synthesized adaptor oligonucleotide
  misc_feature (34)..(36): n is a, c, g, or t
tgcaggaccagagaattcgaatacaaagaaactnnngatcgacatg

SEQ ID NO: 7603 - DNA, 46 bp, Artificial Sequence
  Synthesized adaptor oligonucleotide
  misc_feature (34)..(36): n is a, c, g, or t
tgcaggaccagagaattcgaatacatcctttccnnngatcgacatg

SEQ ID NO: 7604 - DNA, 46 bp, Artificial Sequence
  Synthesized adaptor oligonucleotide
  misc_feature (34)..(36): n is a, c, g, or t
tgcaggaccagagaattcgaatacatggcgtcgnnngatcgacatg

SEQ ID NO: 7605 - DNA, 46 bp, Artificial Sequence
  Synthesized adaptor oligonucleotide
  misc_feature (34)..(36): n is a, c, g, or t
tgcaggaccagagaattcgaatacaggctgtcgnnngatcgacatg

SEQ ID NO: 7606 - DNA, 46 bp, Artificial Sequence
  Synthesized adaptor oligonucleotide
  misc_feature (34)..(36): n is a, c, g, or t
tgcaggaccagagaattcgaatacatgtccatcnnngatcgacatg

SEQ ID NO: 7607 - DNA, 46 bp, Artificial Sequence
  Synthesized adaptor oligonucleotide
  misc_feature (34)..(36): n is a, c, g, or t
tgcaggaccagagaattcgaatacagttggaagnnngatcgacatg

SEQ ID NO: 7608 - DNA, 46 bp, Artificial Sequence
  Synthesized adaptor oligonucleotide
  misc_feature (34)..(36): n is a, c, g, or t
tgcaggaccagagaattcgaatacagtggacggnnngatcgacatg

SEQ ID NO: 7609 - DNA, 46 bp, Artificial Sequence
  Synthesized adaptor oligonucleotide
  misc_feature (34)..(36): n is a, c, g, or t
tgcaggaccagagaattcgaatacatcctggccnnngatcgacatg

SEQ ID NO: 7610 - DNA, 46 bp, Artificial Sequence
  Synthesized adaptor oligonucleotide
  misc_feature (34)..(36): n is a, c, g, or t
tgcaggaccagagaattcgaatacaataggcgannngatcgacatg

SEQ ID NO: 7611 - DNA, 46 bp, Artificial Sequence
  Synthesized adaptor oligonucleotide
  misc_feature (34)..(36): n is a, c, g, or t
tgcaggaccagagaattcgaatacaatccgtgannngatcgacatg

SEQ ID NO: 7612 - DNA, 46 bp, Artificial Sequence
  Synthesized adaptor oligonucleotide
  misc_feature (34)..(36): n is a, c, g, or t
tgcaggaccagagaattcgaatacagtagctgtnnngatcgacatg

SEQ ID NO: 7613 - DNA, 46 bp, Artificial Sequence
  Synthesized adaptor oligonucleotide
  misc_feature (34)..(36): n is a, c, g, or t
tgcaggaccagagaattcgaatacagaagacgtnnngatcgacatg

SEQ ID NO: 7614 - DNA, 46 bp, Artificial Sequence
  Synthesized adaptor oligonucleotide
  misc_feature (34)..(36): n is a, c, g, or t
tgcaggaccagagaattcgaatacatccgtactnnngatcgacatg

SEQ ID NO: 7615 - DNA, 46 bp, Artificial Sequence
  Synthesized adaptor oligonucleotide
  misc_feature (34)..(36): n is a, c, g, or t
tgcaggaccagagaattcgaatacatgaggcaannngatcgacatg

SEQ ID NO: 7616 - DNA, 46 bp, Artificial Sequence
  Synthesized adaptor oligonucleotide
  misc_feature (34)..(36): n is a, c, g, or t
tgcaggaccagagaattcgaatacatgagttatnnngatcgacatg

SEQ ID NO: 7617 - DNA, 46 bp, Artificial Sequence
  Synthesized adaptor oligonucleotide
  misc_feature (34)..(36): n is a, c, g, or t
tgcaggaccagagaattcgaatacaattggtgcnnngatcgacatg

SEQ ID NO: 7618 - DNA, 46 bp, Artificial Sequence
  Synthesized adaptor oligonucleotide
  misc_feature (34)..(36): n is a, c, g, or t
tgcaggaccagagaattcgaatacaggcgttgcnnngatcgacatg

SEQ ID NO: 7619 - DNA, 46 bp, Artificial Sequence
  Synthesized adaptor oligonucleotide
  misc_feature (34)..(36): n is a, c, g, or t
tgcaggaccagagaattcgaatacagcatctctnnngatcgacatg

SEQ ID NO: 7620 - DNA, 46 bp, Artificial Sequence
  Synthesized adaptor oligonucleotide
  misc_feature (34)..(36): n is a, c, g, or t
tgcaggaccagagaattcgaatacaactctccannngatcgacatg

SEQ ID NO: 7621 - DNA, 46 bp, Artificial Sequence
  Synthesized adaptor oligonucleotide
  misc_feature (34)..(36): n is a, c, g, or t
tgcaggaccagagaattcgaatacaataagtagnnngatcgacatg

SEQ ID NO: 7622 - DNA, 46 bp, Artificial Sequence
  Synthesized adaptor oligonucleotide
  misc_feature (34)..(36): n is a, c, g, or t
tgcaggaccagagaattcgaatacagattgccannngatcgacatg

SEQ ID NO: 7623 - DNA, 46 bp, Artificial Sequence
  Synthesized adaptor oligonucleotide
  misc_feature (34)..(36): n is a, c, g, or t
tgcaggaccagagaattcgaatacagttccagannngatcgacatg

SEQ ID NO: 7624 - DNA, 46 bp, Artificial Sequence
  Synthesized adaptor oligonucleotide
  misc_feature (34)..(36): n is a, c, g, or t
tgcaggaccagagaattcgaatacaaaccgtacnnngatcgacatg

SEQ ID NO: 7625 - DNA, 46 bp, Artificial Sequence
  Synthesized adaptor oligonucleotide
  misc_feature (34)..(36): n is a, c, g, or t
tgcaggaccagagaattcgaatacacgcgttggnnngatcgacatg

SEQ ID NO: 7626 - DNA, 46 bp, Artificial Sequence
  Synthesized adaptor oligonucleotide
  misc_feature (34)..(36): n is a, c, g, or t
tgcaggaccagagaattcgaatacaaattccaannngatcgacatg

SEQ ID NO: 7627 - DNA, 46 bp, Artificial Sequence
  Synthesized adaptor oligonucleotide
  misc_feature (34)..(36): n is a, c, g, or t
tgcaggaccagagaattcgaatacatgaccagtnnngatcgacatg

SEQ ID NO: 7628 - DNA, 46 bp, Artificial Sequence
  Synthesized adaptor oligonucleotide
  misc_feature (34)..(36): n is a, c, g, or t
tgcaggaccagagaattcgaatacaatggatttnnngatcgacatg

SEQ ID NO: 7629 - DNA, 46 bp, Artificial Sequence
  Synthesized adaptor oligonucleotide
  misc_feature (34)..(36): n is a, c, g, or t
tgcaggaccagagaattcgaatacaaagtccacnnntgcatcaggt

SEQ ID NO: 7630 - DNA, 46 bp, Artificial Sequence
  Synthesized adaptor oligonucleotide
  misc_feature (34)..(36): n is a, c, g, or t
tgcaggaccagagaattcgaatacagtggcgctnnntgcatcaggt

SEQ ID NO: 7631 - DNA, 46 bp, Artificial Sequence
  Synthesized adaptor oligonucleotide
  misc_feature (34)..(36): n is a, c, g, or t
tgcaggaccagagaattcgaatacatctggatgnnntgcatcaggt

SEQ ID NO: 7632 - DNA, 46 bp, Artificial Sequence
  Synthesized adaptor oligonucleotide
  misc_feature (34)..(36): n is a, c, g, or t
tgcaggaccagagaattcgaatacaccgatgcgnnntgcatcaggt

SEQ ID NO: 7633 - DNA, 46 bp, Artificial Sequence
  Synthesized adaptor oligonucleotide
  misc_feature (34)..(36): n is a, c, g, or t
tgcaggaccagagaattcgaatacaagtgctcannntgcatcaggt

SEQ ID NO: 7634 - DNA, 46 bp, Artificial Sequence
  Synthesized adaptor oligonucleotide
  misc_feature (34)..(36): n is a, c, g, or t
tgcaggaccagagaattcgaatacacaatagttnnntgcatcaggt

SEQ ID NO: 7635 - DNA, 46 bp, Artificial Sequence
  Synthesized adaptor oligonucleotide
  misc_feature (34)..(36): n is a, c, g, or t
tgcaggaccagagaattcgaatacatacaggctnnntgcatcaggt

SEQ ID NO: 7636 - DNA, 46 bp, Artificial Sequence
  Synthesized adaptor oligonucleotide
  misc_feature (34)..(36): n is a, c, g, or t
tgcaggaccagagaattcgaatacatataccttnnntgcatcaggt

SEQ ID NO: 7637 - DNA, 46 bp, Artificial Sequence
  Synthesized adaptor oligonucleotide
  misc_feature (34)..(36): n is a, c, g, or t
tgcaggaccagagaattcgaatacaggagtaacnnntgcatcaggt

SEQ ID NO: 7638 - DNA, 46 bp, Artificial Sequence
  Synthesized adaptor oligonucleotide
  misc_feature (34)..(36): n is a, c, g, or t
tgcaggaccagagaattcgaatacagctatgacnnntgcatcaggt

SEQ ID NO: 7639 - DNA, 46 bp, Artificial Sequence
  Synthesized adaptor oligonucleotide
  misc_feature (34)..(36): n is a, c, g, or t
tgcaggaccagagaattcgaatacagttacacgnnntgcatcaggt

SEQ ID NO: 7640 - DNA, 46 bp, Artificial Sequence
  Synthesized adaptor oligonucleotide
  misc_feature (34)..(36): n is a, c, g, or t
tgcaggaccagagaattcgaatacagaaggaagnnntgcatcaggt

SEQ ID NO: 7641 - DNA, 46 bp, Artificial Sequence
  Synthesized adaptor oligonucleotide
  misc_feature (34)..(36): n is a, c, g, or t
tgcaggaccagagaattcgaatacaatgacttannntgcatcaggt

SEQ ID NO: 7642 - DNA, 46 bp, Artificial Sequence
  Synthesized adaptor oligonucleotide
  misc_feature (34)..(36): n is a, c, g, or t
tgcaggaccagagaattcgaatacatctctaatnnntgcatcaggt

SEQ ID NO: 7643 - DNA, 46 bp, Artificial Sequence
  Synthesized adaptor oligonucleotide
  misc_feature (34)..(36): n is a, c, g, or t
tgcaggaccagagaattcgaatacaggaataatnnntgcatcaggt

SEQ ID NO: 7644 - DNA, 46 bp, Artificial Sequence
  Synthesized adaptor oligonucleotide
  misc_feature (34)..(36): n is a, c, g, or t
tgcaggaccagagaattcgaatacaattatacgnnntgcatcaggt

SEQ ID NO: 7645 - DNA, 46 bp, Artificial Sequence
  Synthesized adaptor oligonucleotide
  misc_feature (34)..(36): n is a, c, g, or t
tgcaggaccagagaattcgaatacacaaaggacnnntgcatcaggt

SEQ ID NO: 7646 - DNA, 46 bp, Artificial Sequence
  Synthesized adaptor oligonucleotide
  misc_feature (34)..(36): n is a, c, g, or t
tgcaggaccagagaattcgaatacaatagaatgnnntgcatcaggt

SEQ ID NO: 7647 - DNA, 46 bp, Artificial Sequence
  Synthesized adaptor oligonucleotide
  misc_feature (34)..(36): n is a, c, g, or t
tgcaggaccagagaattcgaatacaggtctgcgnnntgcatcaggt

SEQ ID NO: 7648 - DNA, 46 bp, Artificial Sequence
  Synthesized adaptor oligonucleotide
  misc_feature (34)..(36): n is a, c, g, or t
tgcaggaccagagaattcgaatacacattttcannntgcatcaggt

SEQ ID NO: 7649 - DNA, 46 bp, Artificial Sequence
  Synthesized adaptor oligonucleotide
  misc_feature (34)..(36): n is a, c, g, or t
tgcaggaccagagaattcgaatacagcagaggcnnntgcatcaggt

SEQ ID NO: 7650 - DNA, 46 bp, Artificial Sequence
  Synthesized adaptor oligonucleotide
  misc_feature (34)..(36): n is a, c, g, or t
tgcaggaccagagaattcgaatacagcggtaggnnntgcatcaggt

SEQ ID NO: 7651 - DNA, 46 bp, Artificial Sequence
  Synthesized adaptor oligonucleotide
  misc_feature (34)..(36): n is a, c, g, or t
tgcaggaccagagaattcgaatacaggagtcggnnntgcatcaggt

SEQ ID NO: 7652 - DNA, 46 bp, Artificial Sequence
  Synthesized adaptor oligonucleotide
  misc_feature (34)..(36): n is a, c, g, or t
tgcaggaccagagaattcgaatacaaccattccnnntgcatcaggt

SEQ ID NO: 7653 - DNA, 46 bp, Artificial Sequence
  Synthesized adaptor oligonucleotide
  misc_feature (34)..(36): n is a, c, g, or t
tgcaggaccagagaattcgaatacatcaaatgtnnntgcatcaggt

SEQ ID NO: 7654 - DNA, 46 bp, Artificial Sequence
  Synthesized adaptor oligonucleotide
  misc_feature (34)..(36): n is a, c, g, or t
tgcaggaccagagaattcgaatacacagttcgannntgcatcaggt

SEQ ID NO: 7655 - DNA, 46 bp, Artificial Sequence
  Synthesized adaptor oligonucleotide
  misc_feature (34)..(36): n is a, c, g, or t
tgcaggaccagagaattcgaatacagatctaatnnntgcatcaggt

SEQ ID NO: 7656 - DNA, 46 bp, Artificial Sequence
  Synthesized adaptor oligonucleotide
  misc_feature (34)..(36): n is a, c, g, or t
tgcaggaccagagaattcgaatacatttcagttnnntgcatcaggt

SEQ ID NO: 7657 - DNA, 46 bp, Artificial Sequence
  Synthesized adaptor oligonucleotide
  misc_feature (34)..(36): n is a, c, g, or t
tgcaggaccagagaattcgaatacagacaatttnnntgcatcaggt

SEQ ID NO: 7658 - DNA, 46 bp, Artificial Sequence
  Synthesized adaptor oligonucleotide
  misc_feature (34)..(36): n is a, c, g, or t
tgcaggaccagagaattcgaatacagccgtaatnnntgcatcaggt

SEQ ID NO: 7659 - DNA, 46 bp, Artificial Sequence
  Synthesized adaptor oligonucleotide
  misc_feature (34)..(36): n is a, c, g, or t
tgcaggaccagagaattcgaatacaaatacaagnnntgcatcaggt

SEQ ID NO: 7660 - DNA, 46 bp, Artificial Sequence
  Synthesized adaptor oligonucleotide
  misc_feature (34)..(36): n is a, c, g, or t
tgcaggaccagagaattcgaatacagtccgcgannntgcatcaggt

SEQ ID NO: 7661 - DNA, 46 bp, Artificial Sequence
  Synthesized adaptor oligonucleotide
  misc_feature (34)..(36): n is a, c, g, or t
tgcaggaccagagaattcgaatacaccatcatcnnntgcatcaggt

SEQ ID NO: 7662 - DNA, 46 bp, Artificial Sequence
  Synthesized adaptor oligonucleotide
  misc_feature (34)..(36): n is a, c, g, or t
tgcaggaccagagaattcgaatacacctgtcatnnntgcatcaggt

SEQ ID NO: 7663 - DNA, 46 bp, Artificial Sequence
  Synthesized adaptor oligonucleotide
  misc_feature (34)..(36): n is a, c, g, or t
tgcaggaccagagaattcgaatacagcttcctannntgcatcaggt

SEQ ID NO: 7664 - DNA, 46 bp, Artificial Sequence
  Synthesized adaptor oligonucleotide
  misc_feature (34)..(36): n is a, c, g, or t
tgcaggaccagagaattcgaatacaacccaacannntgcatcaggt

SEQ ID NO: 7665 - DNA, 46 bp, Artificial Sequence
  Synthesized adaptor oligonucleotide
  misc_feature (34)..(36): n is a, c, g, or t
tgcaggaccagagaattcgaatacaaaacgcgannntgcatcaggt

SEQ ID NO: 7666 - DNA, 46 bp, Artificial Sequence
  Synthesized adaptor oligonucleotide
  misc_feature (34)..(36): n is a, c, g, or t
tgcaggaccagagaattcgaatacatctgcatcnnntgcatcaggt

SEQ ID NO: 7667 - DNA, 46 bp, Artificial Sequence
  Synthesized adaptor oligonucleotide
  misc_feature (34)..(36): n is a, c, g, or t
tgcaggaccagagaattcgaatacaattccaaannntgcatcaggt

SEQ ID NO: 7668 - DNA, 46 bp, Artificial Sequence
  Synthesized adaptor oligonucleotide
  misc_feature (34)..(36): n is a, c, g, or t
tgcaggaccagagaattcgaatacacaccaagtnnntgcatcaggt

SEQ ID NO: 7669 - DNA, 46 bp, Artificial Sequence
  Synthesized adaptor oligonucleotide
  misc_feature (34)..(36): n is a, c, g, or t
tgcaggaccagagaattcgaatacagcacaactnnntgcatcaggt

SEQ ID NO: 7670 - DNA, 46 bp, Artificial Sequence
  Synthesized adaptor oligonucleotide
  misc_feature (34)..(36): n is a, c, g, or t
tgcaggaccagagaattcgaatacaaggtggatnnntgcatcaggt

SEQ ID NO: 7671 - DNA, 46 bp, Artificial Sequence
  Synthesized adaptor oligonucleotide
  misc_feature (34)..(36): n is a, c, g, or t
tgcaggaccagagaattcgaatacatgctagcannntgcatcaggt

SEQ ID NO: 7672 - DNA, 46 bp, Artificial Sequence
  Synthesized adaptor oligonucleotide
  misc_feature (34)..(36): n is a, c, g, or t
tgcaggaccagagaattcgaatacattgtgagcnnntgcatcaggt

SEQ ID NO: 7673 - DNA, 46 bp, Artificial Sequence
  Synthesized adaptor oligonucleotide
  misc_feature (34)..(36): n is a, c, g, or t
tgcaggaccagagaattcgaatacaagtttcggnnntgcatcaggt

SEQ ID NO: 7674 - DNA, 46 bp, Artificial Sequence
  Synthesized adaptor oligonucleotide
  misc_feature (34)..(36): n is a, c, g, or t
tgcaggaccagagaattcgaatacagctagtacnnntgcatcaggt

SEQ ID NO: 7675 - DNA, 46 bp, Artificial Sequence
  Synthesized adaptor oligonucleotide
  misc_feature (34)..(36): n is a, c, g, or t
tgcaggaccagagaattcgaatacataggtgctnnntgcatcaggt

SEQ ID NO: 7676 - DNA, 46 bp, Artificial Sequence
  Synthesized adaptor oligonucleotide
  misc_feature (34)..(36): n is a, c, g, or t
tgcaggaccagagaattcgaatacacattacggnnntgcatcaggt

SEQ ID NO: 7677 - DNA, 46 bp, Artificial Sequence
  Synthesized adaptor oligonucleotide
  misc_feature (34)..(36): n is a, c, g, or t
tgcaggaccagagaattcgaatacatgcaattannntgcatcaggt

SEQ ID NO: 7678 - DNA, 46 bp, Artificial Sequence
  Synthesized adaptor oligonucleotide
  misc_feature (34)..(36): n is a, c, g, or t
tgcaggaccagagaattcgaatacatggcccctnnntgcatcaggt

SEQ ID NO: 7679 - DNA, 46 bp, Artificial Sequence
  Synthesized adaptor oligonucleotide
  misc_feature (34)..(36): n is a, c, g, or t
tgcaggaccagagaattcgaatacagctgcagcnnntgcatcaggt

SEQ ID NO: 7680 - DNA, 46 bp, Artificial Sequence
  Synthesized adaptor oligonucleotide
  misc_feature (34)..(36): n is a, c, g, or t
tgcaggaccagagaattcgaatacatttgcccannntgcatcaggt

SEQ ID NO: 7681 - DNA, 46 bp, Artificial Sequence
  Synthesized adaptor oligonucleotide
  misc_feature (34)..(36): n is a, c, g, or t
tgcaggaccagagaattcgaatacagaccattgnnntgcatcaggt

SEQ ID NO: 7682 - DNA, 46 bp, Artificial Sequence
  Synthesized adaptor oligonucleotide
  misc_feature (34)..(36): n is a, c, g, or t
tgcaggaccagagaattcgaatacaccgcgtagnnntgcatcaggt

SEQ ID NO: 7683 - DNA, 46 bp, Artificial Sequence
  Synthesized adaptor oligonucleotide
  misc_feature (34)..(36): n is a, c, g, or t
tgcaggaccagagaattcgaatacattagctggnnntgcatcaggt

SEQ ID NO: 7684 - DNA, 46 bp, Artificial Sequence
  Synthesized adaptor oligonucleotide
  misc_feature (34)..(36): n is a, c, g, or t
tgcaggaccagagaattcgaatacatctgatttnnntgcatcaggt

SEQ ID NO: 7685 - DNA, 46 bp, Artificial Sequence
  Synthesized adaptor oligonucleotide
  misc_feature (34)..(36): n is a, c, g, or t
tgcaggaccagagaattcgaatacatcataggcnnntgcatcaggt

SEQ ID NO: 7686 - DNA, 46 bp, Artificial Sequence
  Synthesized adaptor oligonucleotide
  misc_feature (34)..(36): n is a, c, g, or t
tgcaggaccagagaattcgaatacatggaggtannntgcatcaggt

SEQ ID NO: 7687 - DNA, 46 bp, Artificial Sequence
  Synthesized adaptor oligonucleotide
  misc_feature (34)..(36): n is a, c, g, or t
tgcaggaccagagaattcgaatacagtctctacnnntgcatcaggt

SEQ ID NO: 7688 - DNA, 46 bp, Artificial Sequence
  Synthesized adaptor olignucleotide
  misc_feature (34)..(36): n is a, c, g, or t
tgcaggaccagagaattcgaatacagcctggtgnnntgcatcaggt

SEQ ID NO: 7689 - DNA, 40 bp, Artificial Sequence
  Synthesized TP53 oligonucleotide probes
ggcacagaccctctcactcatgtgatgtcatctctcctcc

SEQ ID NO: 7690 - DNA, 40 bp, Artificial Sequence
  Synthesized TP53 oligonucleotide probes
atgggggtgggaggctgtcagtggggaacaagaagtggag

SEQ ID NO: 7691 - DNA, 40 bp, Artificial Sequence
  Synthesized TP53 oligonucleotide probes
gtcagtctgagtcaggcccttctgtcttgaacatgagttt

SEQ ID NO: 7692 - DNA, 40 bp, Artificial Sequence
  Synthesized TP53 oligonucleotide probes
cctgaagtccaaaaagggtcagtctacctcccgccataaa

SEQ ID NO: 7693 - DNA, 40 bp, Artificial Sequence
  Synthesized TP53 oligonucleotide probes
tcatgctggatccccacttttcctcttgcagcagccagac

SEQ ID NO: 7694 - DNA, 40 bp, Artificial Sequence
  Synthesized TP53 oligonucleotide probes
gttggggtgggggtggtgggcctgcccttccaatggatcc

SEQ ID NO: 7695 - DNA, 40 bp, Artificial Sequence
  Synthesized TP53 oligonucleotide probes
cagtttccataggtctgaaaatgtttcctgactcagaggg

SEQ ID NO: 7696 - DNA, 40 bp, Artificial Sequence
  Synthesized TP53 oligonucleotide probes
ctgccatggaggagccgcagtcagatcctagcgtcgagcc

SEQ ID NO: 7697 - DNA, 40 bp, Artificial Sequence
  Synthesized TP53 oligonucleotide probes
gcagagacctgtgggaagcgaaaattccatgggactgact

SEQ ID NO: 7698 - DNA, 40 bp, Artificial Sequence
  Synthesized TP53 oligonucleotide probes
ctggggggctggggggctgaggacctggtcctctgactgc

SEQ ID NO: 7699 - DNA, 40 bp, Artificial Sequence
  Synthesized TP53 oligonucleotide probes
gcagggggatacggccaggcattgaagtctcatggaagcc

SEQ ID NO: 7700 - DNA, 40 bp, Artificial Sequence
  Synthesized TP53 oligonucleotide probes
gtggcccctgcaccagcagctcctacaccggcggcccctg

SEQ ID NO: 7701 - DNA, 40 bp, Artificial Sequence
  Synthesized TP53 oligonucleotide probes
ggggggagcagcctctggcattctgggagcttcatctgga

SEQ ID NO: 7702 - DNA, 40 bp, Artificial Sequence
  Synthesized TP53 oligonucleotide probes
ccgtgcaagtcacagacttggctgtcccagaatgcaagaa

SEQ ID NO: 7703 - DNA, 40 bp, Artificial Sequence
  Synthesized TP53 oligonucleotide probes
ccccggacgatattgaacaatggttcactgaagacccagg

SEQ ID NO: 7704 - DNA, 40 bp, Artificial Sequence
  Synthesized TP53 oligonucleotide probes
ccagaaaacctaccagggcagctacggtttccgtctgggc

SEQ ID NO: 7705 - DNA, 40 bp, Artificial Sequence
  Synthesized TP53 oligonucleotide probes
taggttttctgggaagggacagaagatgacaggggccagg

SEQ ID NO: 7706 - DNA, 40 bp, Artificial Sequence
  Synthesized TP53 oligonucleotide probes
tgctttatctgttcacttgtgccctgactttcaactctgt

SEQ ID NO: 7707 - DNA, 40 bp, Artificial Sequence
  Synthesized TP53 oligonucleotide probes
cctgggcaaccagccctgtcgtctctccagccccagctgc

SEQ ID NO: 7708 - DNA, 40 bp, Artificial Sequence
  Synthesized TP53 oligonucleotide probes
tttgccaactggccaagacctgccctgtgcagctgtgggt

SEQ ID NO: 7709 - DNA, 40 bp, Artificial Sequence
  Synthesized TP53 oligonucleotide probes
ccatcgctatctgagcagcgctcatggtgggggcagcgcc

SEQ ID NO: 7710 - DNA, 40 bp, Artificial Sequence
  Synthesized TP53 oligonucleotide probes
gccatctacaagcagtcacagcacatgacggaggttgtga

SEQ ID NO: 7711 - DNA, 40 bp, Artificial Sequence
  Synthesized TP53 oligonucleotide probes
catggcgcggacgcgggtgccgggcgggggtgtggaatca

SEQ ID NO: 7712 - DNA, 40 bp, Artificial Sequence
  Synthesized TP53 oligonucleotide probes
ccagggtccccaggcctctgattcctcactgattgctctt

SEQ ID NO: 7713 - DNA, 40 bp, Artificial Sequence
  Synthesized TP53 oligonucleotide probes
gagggccactgacaaccacccttaacccctcctcccagag

SEQ ID NO: 7714 - DNA, 40 bp, Artificial Sequence
  Synthesized TP53 oligonucleotide probes
cctcaggcggctcatagggcaccaccacactatgtcgaaa

SEQ ID NO: 7715 - DNA, 40 bp, Artificial Sequence
  Synthesized TP53 oligonucleotide probes
aggaaatttgcgtgtggagtatttggatgacagaaacact

SEQ ID NO: 7716 - DNA, 40 bp, Artificial Sequence
  Synthesized TP53 oligonucleotide probes
cttgccacaggtctccccaaggcgcactggcctcatcttg

SEQ ID NO: 7717 - DNA, 40 bp, Artificial Sequence
  Synthesized TP53 oligonucleotide probes
gaggcaagcagaggctggggcacagcaggccagtgtgcag

SEQ ID NO: 7718 - DNA, 40 bp, Artificial Sequence
  Synthesized TP53 oligonucleotide probes
cctggagtcttccagtgtgatgatggtgaggatgggcctc

SEQ ID NO: 7719 - DNA, 40 bp, Artificial Sequence
  Synthesized TP53 oligonucleotide probes
actacatgtgtaacagttcctgcatgggcggcatgaaccg

SEQ ID NO: 7720 - DNA, 40 bp, Artificial Sequence
  Synthesized TP53 oligonucleotide probes
ggacaggtaggacctgatttccttactgcctcttgcttct

SEQ ID NO: 7721 - DNA, 40 bp, Artificial Sequence
  Synthesized TP53 oligonucleotide probes
ctgcacccttggtctcctccaccgcttcttgtcctgcttg

SEQ ID NO: 7722 - DNA, 40 bp, Artificial Sequence
  Synthesized TP53 oligonucleotide probes
tctcttttcctatcctgagtagtggtaatctactgggacg

SEQ ID NO: 7723 - DNA, 40 bp, Artificial Sequence
  Synthesized TP53 oligonucleotide probes
cctcgcttagtgctccctgggggcagctcgtggtgaggct

SEQ ID NO: 7724 - DNA, 40 bp, Artificial Sequence
  Synthesized TP53 oligonucleotide probes
gaccggcgcacagaggaagagaatctccgcaagaaagggg

SEQ ID NO: 7725 - DNA, 40 bp, Artificial Sequence
  Synthesized TP53 oligonucleotide probes
tctcccaggacaggcacaaacacgcacctcaaagctgttc

SEQ ID NO: 7726 - DNA, 40 bp, Artificial Sequence
  Synthesized TP53 oligonucleotide probes
tgcctcagattcacttttatcacctttccttgcctctttc

SEQ ID NO: 7727 - DNA, 40 bp, Artificial Sequence
  Synthesized TP53 oligonucleotide probes
ggcattttgagtgttagactggaaactttccacttgataa

SEQ ID NO: 7728 - DNA, 40 bp, Artificial Sequence
  Synthesized TP53 oligonucleotide probes
cctgaagggtgaaatattctccatccagtggtttcttctt

SEQ ID NO: 7729 - DNA, 40 bp, Artificial Sequence
  Synthesized TP53 oligonucleotide probes
cctagcactgcccaacaacaccagctcctctccccagcca

SEQ ID NO: 7730 - DNA, 40 bp, Artificial Sequence
  Synthesized TP53 oligonucleotide probes
catcttttaactcaggtactgtgtatatacttacttctcc

SEQ ID NO: 7731 - DNA, 40 bp, Artificial Sequence
  Synthesized TP53 oligonucleotide probes
atggctttccaacctaggaaggcaggggagtagggccagg

SEQ ID NO: 7732 - DNA, 40 bp, Artificial Sequence
  Synthesized TP53 oligonucleotide probes
cctggagtgagccctgctcccccctggctccttcccagcc

SEQ ID NO: 7733 - DNA, 40 bp, Artificial Sequence
  Synthesized TP53 oligonucleotide probes
tccgagagctgaatgaggccttggaactcaaggatgccca

SEQ ID NO: 7734 - DNA, 40 bp, Artificial Sequence
  Synthesized control oligonucleotide probe
gtgtctcggcaaccactcttcaccaatatcacagtggaca

SEQ ID NO: 7735 - DNA, 40 bp, Artificial Sequence
  Synthesized control oligonucleotide probe
atccaaggggaggagatcagtgcccctatttgtatcgcac

SEQ ID NO: 7736 - DNA, 40 bp, Artificial Sequence
  Synthesized control oligonucleotide probe
acttactgaagcaagaacctcatcaagctgcctcccacca

SEQ ID NO: 7737 - DNA, 40 bp, Artificial Sequence
  Synthesized control oligonucleotide probe
agtttgtgatcctcctgtgggcaacctcagcagtctggtt

SEQ ID NO: 7738 - DNA, 40 bp, Artificial Sequence
  Synthesized control oligonucleotide probe
ggagagcggagctgctcagagcttggccaggttctaagtg

SEQ ID NO: 7739 - DNA, 40 bp, Artificial Sequence
  Synthesized control oligonucleotide probe
gactgtggcaatgaggcagctaagtggttcaccaacttct

SEQ ID NO: 7740 - DNA, 40 bp, Artificial Sequence
  Synthesized control oligonucleotide probe
ggtgtattttgacaacggtggacccagacactggagtcat

SEQ ID NO: 7741 - DNA, 40 bp, Artificial Sequence
  Synthesized control oligonucleotide probe
gttggtctattcttgcggttgtaaaagtggcccagagtga

SEQ ID NO: 7742 - DNA, 40 bp, Artificial Sequence
  Synthesized control oligonucleotide probe
gtgagccttctctcaccattctgtccaaaatagcagccct

SEQ ID NO: 7743 - DNA, 40 bp, Artificial Sequence
  Synthesized control oligonucleotide probe
cagcctagatatgattcctcactaccctgttccatggttc

SEQ ID NO: 7744 - DNA, 40 bp, Artificial Sequence
  Synthesized control oligonucleotide probe
aaagaatgtgttggctcatgatcagacttgagcacttggg

SEQ ID NO: 7745 - DNA, 40 bp, Artificial Sequence
  Synthesized control oligonucleotide probe
cctaggctgttgctgctggacctgtttgtgcttcatcaca

SEQ ID NO: 7746 - DNA, 40 bp, Artificial Sequence
  Synthesized control oligonucleotide probe
cagttgacccttcagccacaggggtttgaactttgaagga

SEQ ID NO: 7747 - DNA, 40 bp, Artificial Sequence
  Synthesized control oligonucleotide probe
aggacctgagtatgcacgttttggtatactgggtaggggt

SEQ ID NO: 7748 - DNA, 40 bp, Artificial Sequence
  Synthesized control oligonucleotide probe
tatcagctgggatggtccggtcagcagcattaccctgttt

SEQ ID NO: 7749 - DNA, 40 bp, Artificial Sequence
  Synthesized control oligonucleotide probe
tgcctgctcagcccagatttcagtcatgctggccataaac

SEQ ID NO: 7750 - DNA, 40 bp, Artificial Sequence
  Synthesized control oligonucleotide probe
ctggggggtgaggtttgaggtttgagtgtgggatgtgagg

SEQ ID NO: 7751 - DNA, 40 bp, Artificial Sequence
  Synthesized control oligonucleotide probe
ccagctttttcagaagctgggaaagtaataacccgtgttg

SEQ ID NO: 7752 - DNA, 40 bp, Artificial Sequence
  Synthesized control oligonucleotide probe
cccagcgcccgtggctttggctcctcagtcccatttaaat

SEQ ID NO: 7753 - DNA, 40 bp, Artificial Sequence
  Synthesized control oligonucleotide probe
tataccaccaagtctacctactgcctgcacatgctatggc

SEQ ID NO: 7754 - DNA, 40 bp, Artificial Sequence
  Synthesized control oligonucleotide probe
ggtcaatccggcactactggttgtccaaagggaggttact

SEQ ID NO: 7755 - DNA, 40 bp, Artificial Sequence
  Synthesized control oligonucleotide probe
aatcaaacatcaggaccgcccacagcacaggtcaatgaac

SEQ ID NO: 7756 - DNA, 40 bp, Artificial Sequence
  Synthesized control oligonucleotide probe
gtgtctcctggaggtgcatgggtggttttgaacttcattg

SEQ ID NO: 7757 - DNA, 40 bp, Artificial Sequence
  Synthesized control oligonucleotide probe
gacccatgtaaggggttgggttatgttctccttttgccca

SEQ ID NO: 7758 - DNA, 40 bp, Artificial Sequence
  Synthesized control oligonucleotide probe
tcactgacatgcgaagctgggaacgagaaaatgcacatcc

SEQ ID NO: 7759 - DNA, 40 bp, Artificial Sequence
  Synthesized control oligonucleotide probe
tcctacagtgcttagggatgaatctggcaaagaaggatgc

SEQ ID NO: 7760 - DNA, 40 bp, Artificial Sequence
  Synthesized control oligonucleotide probe
gaaagcagtccttaccacaagaagaccccgatgtggtggt

SEQ ID NO: 7761 - DNA, 40 bp, Artificial Sequence
  Synthesized control oligonucleotide probe
attgctcactggctggcttgcatttggtatgcgattggga

SEQ ID NO: 7762 - DNA, 40 bp, Artificial Sequence
  Synthesized control oligonucleotide probe
gtccctgggaccatctgtgcattgttcttgtaactggaaa

SEQ ID NO: 7763 - DNA, 40 bp, Artificial Sequence
  Synthesized control oligonucleotide probe
gaccgaatggcgaacgcagtgaatagatcaggagggaaaa

SEQ ID NO: 7764 - DNA, 40 bp, Artificial Sequence
  Synthesized control oligonucleotide probe
gaaggaatggagtggaacagataggggtgagggaataacg

SEQ ID NO: 7765 - DNA, 40 bp, Artificial Sequence
  Synthesized control oligonucleotide probe
ccactgccatcctcagagggagattcacaagtctcacaat

SEQ ID NO: 7766 - DNA, 40 bp, Artificial Sequence
  Synthesized control oligonucleotide probe
atccaggcttcatgttcaaatgcaatggcccttgccccat

SEQ ID NO: 7767 - DNA, 40 bp, Artificial Sequence
  Synthesized control oligonucleotide probe
aaatttcccctggctccctactgctttgcaggccaagtaa

SEQ ID NO: 7768 - DNA, 40 bp, Artificial Sequence
  Synthesized control oligonucleotide probe
accttaaagacgggcccacatctctttggatgggattagg

SEQ ID NO: 7769 - DNA, 40 bp, Artificial Sequence
  Synthesized control oligonucleotide probe
gggcttcggttttggcgaaggtgctcacaatcttgatatc

SEQ ID NO: 7770 - DNA, 40 bp, Artificial Sequence
  Synthesized control oligonucleotide probe
tgagctgtccttcatgcctgcatttcccatgtctgtcttc

SEQ ID NO: 7771 - DNA, 40 bp, Artificial Sequence
  Synthesized control oligonucleotide probe
atctttatccagggctaccagtggtgggtccaaaatgact

SEQ ID NO: 7772 - DNA, 40 bp, Artificial Sequence
  Synthesized control oligonucleotide probe
tacaggtgaaggatgtcaacgagtttgctcccaccttcaa

SEQ ID NO: 7773 - DNA, 40 bp, Artificial Sequence
  Synthesized control oligonucleotide probe
gctgttgtgacggagggcaagatctatgacagcattctgc

SEQ ID NO: 7774 - DNA, 40 bp, Artificial Sequence
  Synthesized control oligonucleotide probe
aatgaaggggattcaagccttgccaccgacttacaggaag

SEQ ID NO: 7775 - DNA, 40 bp, Artificial Sequence
  Synthesized control oligonucleotide probe
tgtgagcgtactttctcccccaggttgaagaggaatgagt

SEQ ID NO: 7776 - DNA, 40 bp, Artificial Sequence
  Synthesized control oligonucleotide probe
attccaagtccaggtcccaaatctatcagtaccggctggc

SEQ ID NO: 7777 - DNA, 40 bp, Artificial Sequence
  Synthesized control oligonucleotide probe
gacacagagtgcatgaagaccgttcaaatatgtcagggac

SEQ ID NO: 7778 - DNA, 40 bp, Artificial Sequence
  Synthesized control oligonucleotide probe
catgagtccttctatgactccctctcagacatgcaggaag

SEQ ID NO: 7779 - DNA, 40 bp, Artificial Sequence
  Synthesized control oligonucleotide probe
tttttaggagacaggtacccactgtctggtgacgaggact

SEQ ID NO: 7780 - DNA, 40 bp, Artificial Sequence
  Synthesized control oligonucleotide probe
ccttctgttgagtcgctaggagatgcctcagttcaacaat

SEQ ID NO: 7781 - DNA, 40 bp, Artificial Sequence
  Synthesized control oligonucleotide probe
gacagaaacttcatacccaagagctgctttctcagctgga

SEQ ID NO: 7782 - DNA, 40 bp, Artificial Sequence
  Synthesized control oligonucleotide probe
caggcaactttggcaagaccaagtcagccttctcatctct

SEQ ID NO: 7783 - DNA, 40 bp, Artificial Sequence
  Synthesized control oligonucleotide probe
cccttgctaccatcactgttgtcatctgtgcttgcattcc

SEQ ID NO: 7784 - DNA, 40 bp, Artificial Sequence
  Synthesized control oligonucleotide probe
aggtctcactccaactgcccctgtattagagctaggctgc

SEQ ID NO: 7785 - DNA, 40 bp, Artificial Sequence
  Synthesized control oligonucleotide probe
gaaaccatgcgggattcatctttgtcagagtggagcggca

SEQ ID NO: 7786 - DNA, 40 bp, Artificial Sequence
  Synthesized control oligonucleotide probe
tatgaaattaggcggtggttggacgtgactgtgtgttgac

SEQ ID NO: 7787 - DNA, 40 bp, Artificial Sequence
  Synthesized control oligonucleotide probe
tgaaacttgcatgacatactgcggctgcccattcactagg

SEQ ID NO: 7788 - DNA, 40 bp, Artificial Sequence
  Synthesized control oligonucleotide probe
tgcttcttgtttataactcccctggccaccatctcgggct

SEQ ID NO: 7789 - DNA, 40 bp, Artificial Sequence
  Synthesized control oligonucleotide probe
attccctctcatttgtggttggtggctggatatctgttcc

SEQ ID NO: 7790 - DNA, 40 bp, Artificial Sequence
  Synthesized control oligonucleotide probe
agcatcagcatttccctgtggacttacctctctcagtagt

SEQ ID NO: 7791 - DNA, 40 bp, Artificial Sequence
  Synthesized control oligonucleotide probe
aaaatttaaaggtcggcggtaaggctgaaagccaacaggc

SEQ ID NO: 7792 - DNA, 40 bp, Artificial Sequence
  Synthesized control oligonucleotide probe
gagtgtgtcggtcagaaggaacacctgagaaaccgcttta

SEQ ID NO: 7793 - DNA, 40 bp, Artificial Sequence
  Synthesized control oligonucleotide probe
catagcaaatacctgtcgctgagccaggagtaaagtctgg

SEQ ID NO: 7794 - DNA, 40 bp, Artificial Sequence
  Synthesized control oligonucleotide probe
aagaggctctgagctcttgatagaggttacatggggagca

SEQ ID NO: 7795 - DNA, 40 bp, Artificial Sequence
  Synthesized control oligonucleotide probe
ggagacaacttaggaggttatctagaccattcccgccttc

SEQ ID NO: 7796 - DNA, 40 bp, Artificial Sequence
  Synthesized control oligonucleotide probe
gtgtttcctcccagcatgcactttgtggctgcctttcttt

SEQ ID NO: 7797 - DNA, 40 bp, Artificial Sequence
  Synthesized control oligonucleotide probe
tggcttgtgtagcgtgtttcattttggaaccttggagccg

SEQ ID NO: 7798 - DNA, 40 bp, Artificial Sequence
  Synthesized control oligonucleotide probe
gacacctctggtgcagttttgaggctggccgggaagggat

SEQ ID NO: 7799 - DNA, 40 bp, Artificial Sequence
  Synthesized control oligonucleotide probe
gtttcagatcttgcaatgggagggatcgactcggcccttt

SEQ ID NO: 7800 - DNA, 40 bp, Artificial Sequence
  Synthesized control oligonucleotide probe
tgcctaaatcagaaatgggctacttcccttggccacatcc

SEQ ID NO: 7801 - DNA, 40 bp, Artificial Sequence
  Synthesized control oligonucleotide probe
caatctaccacctcaaggttcacgcgtggattctacacct

SEQ ID NO: 7802 - DNA, 40 bp, Artificial Sequence
  Synthesized control oligonucleotide probe
gagtttttctttcaggtagtctgagatggcccgcaccaag

SEQ ID NO: 7803 - DNA, 40 bp, Artificial Sequence
  Synthesized control oligonucleotide probe
tactataaagaaggcacctctaggcttggcaagcacacgt

SEQ ID NO: 7804 - DNA, 40 bp, Artificial Sequence
  Synthesized control oligonucleotide probe
ggcagattcgatgggactttagacacttgctttgctccct

SEQ ID NO: 7805 - DNA, 40 bp, Artificial Sequence
  Synthesized control oligonucleotide probe
caaatgtccccatgcaaacatgtcccgcactgtgtggtaa

SEQ ID NO: 7806 - DNA, 40 bp, Artificial Sequence
  Synthesized control oligonucleotide probe
acatgtgtaatcttcttctcctagggcggcagaactcatg

SEQ ID NO: 7807 - DNA, 40 bp, Artificial Sequence
  Synthesized control oligonucleotide probe
cccgaggaaagctcctctttgctgactgtaatgtactgca

SEQ ID NO: 7808 - DNA, 40 bp, Artificial Sequence
  Synthesized control oligonucleotide probe
gaggacagcattcgcatatcaggtcgaaatttctccgcga

SEQ ID NO: 7809 - DNA, 40 bp, Artificial Sequence
  Synthesized control oligonucleotide probe
gtccagctttcatccttgatcctgctactctaggctctcc

SEQ ID NO: 7810 - DNA, 40 bp, Artificial Sequence
  Synthesized control oligonucleotide probe
actgatggtgttcacttgcaccatcaggtctgatggagga

SEQ ID NO: 7811 - DNA, 40 bp, Artificial Sequence
  Synthesized control oligonucleotide probe
aattggttcacaaagcgtcgggtgatccagtaacagtcga

SEQ ID NO: 7812 - DNA, 40 bp, Artificial Sequence
  Synthesized control oligonucleotide probe
cagaactctgctctaacgccaagccttcaatatgtcttcg

SEQ ID NO: 7813 - DNA, 40 bp, Artificial Sequence
  Synthesized control oligonucleotide probe
caattcttaccatccacaaaatggatccagacaactgttc

SEQ ID NO: 7814 - DNA, 40 bp, Artificial Sequence
  Synthesized control oligonucleotide probe
actacacctcagatatatttcttcatgaagacctcacagt

SEQ ID NO: 7815 - DNA, 40 bp, Artificial Sequence
  Synthesized control oligonucleotide probe
tgctatagacgcacaaacgaccgcgagccacaaatcaagc

SEQ ID NO: 7816 - DNA, 40 bp, Artificial Sequence
  Synthesized control oligonucleotide probe
ccatgacttatgtgcagcttgcgcatccaggggtagatct

SEQ ID NO: 7817 - DNA, 40 bp, Artificial Sequence
  Synthesized control oligonucleotide probe
aggagttggtggctaaaccgctgacttttctattgcagac

SEQ ID NO: 7818 - DNA, 40 bp, Artificial Sequence
  Synthesized control oligonucleotide probe
gaaatataacaggaccagaagtggctcgcaggagactcat

SEQ ID NO: 7819 - DNA, 40 bp, Artificial Sequence
  Synthesized control oligonucleotide probe
tagccagacagaaggcggacactgatgatacctcaagact

SEQ ID NO: 7820 - DNA, 40 bp, Artificial Sequence
  Synthesized control oligonucleotide probe
gtttgccaccagcgaagagagccatcctggtagaattgga

SEQ ID NO: 7821 - DNA, 40 bp, Artificial Sequence
  Synthesized control oligonucleotide probe
ggagatatgcacttgccctttggtaatcctgctccttctg

SEQ ID NO: 7822 - DNA, 40 bp, Artificial Sequence
  Synthesized control oligonucleotide probe
aaaactaaccagtaagtacagggagggaccgagaggcatc

SEQ ID NO: 7823 - DNA, 40 bp, Artificial Sequence
  Synthesized control oligonucleotide probe
aagaacaccagtccataaagacgcatgtccggtgatgcct

SEQ ID NO: 7824 - DNA, 40 bp, Artificial Sequence
  Synthesized control oligonucleotide probe
aatctgtttagactgagcaactgtgccagcagagggacct

SEQ ID NO: 7825 - DNA, 40 bp, Artificial Sequence
  Synthesized control oligonucleotide probe
aagatggcgaaggtctcagagctttacgatgtcacttggg

SEQ ID NO: 7826 - DNA, 40 bp, Artificial Sequence
  Synthesized control oligonucleotide probe
ccatgcctgccagctgataagatttggttacctttccatg

SEQ ID NO: 7827 - DNA, 40 bp, Artificial Sequence
  Synthesized control oligonucleotide probe
gctgcaagaaagcgtaagattgccattcgaaaagcccagg

SEQ ID NO: 7828 - DNA, 40 bp, Artificial Sequence
  Synthesized control oligonucleotide probe
atgcaggagtacaatgtgggcatgtccaccctctacgaca

SEQ ID NO: 7829 - DNA, 40 bp, Artificial Sequence
  Synthesized control oligonucleotide probe
agaacggctttgctgtcttccggcaaacctatggttctga

SEQ ID NO: 7830 - DNA, 40 bp, Artificial Sequence
  Synthesized control oligonucleotide probe
tggctttggcgctttaaggccagacacggcattaaaaagc

SEQ ID NO: 7831 - DNA, 40 bp, Artificial Sequence
  Synthesized control oligonucleotide probe
gcaggcagagaaagatggctttagaaacctcttccccacc

SEQ ID NO: 7832 - DNA, 40 bp, Artificial Sequence
  Synthesized control oligonucleotide probe
tcagctgtggccattggtggatctcatccttagtactagt

SEQ ID NO: 7833 - DNA, 40 bp, Artificial Sequence
  Synthesized control oligonucleotide probe
ccatggttctgtgagactggtagaaagcacagacccctta

SEQ ID NO: 7834 - DNA, 40 bp, Artificial Sequence
  Synthesized control oligonucleotide probe
aatgtgcttatcactcgtgatggggtcctgaagctggcag

SEQ ID NO: 7835 - DNA, 40 bp, Artificial Sequence
  Synthesized control oligonucleotide probe
agggtctcattttaagacagcttgatttgagggtgagggg

SEQ ID NO: 7836 - DNA, 40 bp, Artificial Sequence
  Synthesized control oligonucleotide probe
cagttgcaaaccatacttccttcagcccagtcctgtctat

SEQ ID NO: 7837 - DNA, 40 bp, Artificial Sequence
  Synthesized control oligonucleotide probe
gtctaagggcatcttacctccaagaactgcttgaggcgta

SEQ ID NO: 7838 - DNA, 40 bp, Artificial Sequence
  Synthesized control oligonucleotide probe
tacctagggaatgaccactaagcaccatctccgtcactct

SEQ ID NO: 7839 - DNA, 40 bp, Artificial Sequence
  Synthesized control oligonucleotide probe
ggaagagaggagggtcatccagtcagttttgcaggaatct

SEQ ID NO: 7840 - DNA, 40 bp, Artificial Sequence
  Synthesized control oligonucleotide probe
tgctgcagtgtcggaagaaacctacctgcgtttcttagaa

SEQ ID NO: 7841 - DNA, 40 bp, Artificial Sequence
  Synthesized control oligonucleotide probe
catcatacctatggcatagccatcagggcactgcagtttg

SEQ ID NO: 7842 - DNA, 40 bp, Artificial Sequence
  Synthesized control oligonucleotide probe
tatatctcacgtgaccgaggatgggtcgtgggcattcaca

SEQ ID NO: 7843 - DNA, 40 bp, Artificial Sequence
  Synthesized control oligonucleotide probe
gaaatggccatctataggtgggaaccactccagtgtcaca

SEQ ID NO: 7844 - DNA, 40 bp, Artificial Sequence
  Synthesized control oligonucleotide probe
ggaaacctttcagtctctactagaagcgcggagagaactc

SEQ ID NO: 7845 - DNA, 40 bp, Artificial Sequence
  Synthesized control oligonucleotide probe
tctggccggcattcatttaaggcctaaggatgaaggcggt

SEQ ID NO: 7846 - DNA, 40 bp, Artificial Sequence
  Synthesized control oligonucleotide probe
agataccctatcgttccttatctcagcgaaacaactcccc

SEQ ID NO: 7847 - DNA, 40 bp, Artificial Sequence
  Synthesized control oligonucleotide probe
cgcaactcctccagatcgcagtggtgcttcttcactttca

SEQ ID NO: 7848 - DNA, 40 bp, Artificial Sequence
  Synthesized control oligonucleotide probe
tgattccatggttgcccgtatactccataaggcggtactt

SEQ ID NO: 7849 - DNA, 40 bp, Artificial Sequence
  Synthesized control oligonucleotide probe
ataccatatccggcttggttaggaggaggtattacagggg

SEQ ID NO: 7850 - DNA, 40 bp, Artificial Sequence
  Synthesized control oligonucleotide probe
gtacctgttaacccagacgcaattcctccacagtacacag

SEQ ID NO: 7851 - DNA, 40 bp, Artificial Sequence
  Synthesized control oligonucleotide probe
atgtgacacttgcatccagggaggtcaccatctgtgtatg

SEQ ID NO: 7852 - DNA, 40 bp, Artificial Sequence
  Synthesized control oligonucleotide probe
ctaggtcctgaagaggtggcaaggaaccaggacagaacat

SEQ ID NO: 7853 - DNA, 40 bp, Artificial Sequence
  Synthesized control oligonucleotide probe
tctgtcattggtgacgccatctagactcttggctttggga

SEQ ID NO: 7854 - DNA, 40 bp, Artificial Sequence
  Synthesized control oligonucleotide probe
aaggtatagagctgggcggctttcctcgttataggtggag

SEQ ID NO: 7855 - DNA, 40 bp, Artificial Sequence
  Synthesized control oligonucleotide probe
ctcctacgtagccgggtagaaacttatggcagaagtcagg

SEQ ID NO: 7856 - DNA, 40 bp, Artificial Sequence
  Synthesized control oligonucleotide probe
tggattcccagggttaattgtgacccattgcaggaaggtg

SEQ ID NO: 7857 - DNA, 40 bp, Artificial Sequence
  Synthesized control oligonucleotide probe
aatgctgtcctactatggtctgtacctgtcccagaggtgg

SEQ ID NO: 7858 - DNA, 40 bp, Artificial Sequence
  Synthesized control oligonucleotide probe
gtgcacctggagagcatacagggcactgacttgtagatca

SEQ ID NO: 7859 - DNA, 40 bp, Artificial Sequence
  Synthesized control oligonucleotide probe
ttccatctcgcataacctgcccctaaactcttctcggttc

SEQ ID NO: 7860 - DNA, 40 bp, Artificial Sequence
  Synthesized control oligonucleotide probe
atgaaggcctgctttgagttatcagataggaaggggccag

SEQ ID NO: 7861 - DNA, 40 bp, Artificial Sequence
  Synthesized control oligonucleotide probe
aggtcatgtcccgcttttggctgaacctagttttgcccaa

SEQ ID NO: 7862 - DNA, 40 bp, Artificial Sequence
  Synthesized control oligonucleotide probe
ctgcattctccatgagtagagtacgagcctcatgttggta

SEQ ID NO: 7863 - DNA, 40 bp, Artificial Sequence
  Synthesized control oligonucleotide probe
aaggctgtcttcaccaactgggtaggtgtggatcaagacc

SEQ ID NO: 7864 - DNA, 40 bp, Artificial Sequence
  Synthesized control oligonucleotide probe
ctgactttggtgttggggagtcggtggtccttcttccatt

SEQ ID NO: 7865 - DNA, 40 bp, Artificial Sequence
  Synthesized control oligonucleotide probe
actgcagaggaccagactgggaaaacaacgatatggcagg

SEQ ID NO: 7866 - DNA, 40 bp, Artificial Sequence
  Synthesized control oligonucleotide probe
cctggcttagaagtctggccggtccttcttcagcttctta

SEQ ID NO: 7867 - DNA, 40 bp, Artificial Sequence
  Synthesized control oligonucleotide probe
aatctcagaaagagttcctgggaccatggcaaatggtggc

SEQ ID NO: 7868 - DNA, 40 bp, Artificial Sequence
  Synthesized control oligonucleotide probe
acattatatccggtccaggaatatctggctcaggctgggt

SEQ ID NO: 7869 - DNA, 40 bp, Artificial Sequence
  Synthesized control oligonucleotide probe
aagcacaggaaatgtgcctcacacgacttcacatgccctt

SEQ ID NO: 7870 - DNA, 40 bp, Artificial Sequence
  Synthesized control oligonucleotide probe
gggggctttgcgggaagaggggactaaacaacccttctgt

SEQ ID NO: 7871 - DNA, 40 bp, Artificial Sequence
  Synthesized control oligonucleotide probe
aaaagaaatgcgatcagcgcaacccatccggtgtggcgct

SEQ ID NO: 7872 - DNA, 40 bp, Artificial Sequence
  Synthesized control oligonucleotide probe
ggcagtggtaccatgacatacttagcagagatggactaca

SEQ ID NO: 7873 - DNA, 40 bp, Artificial Sequence
  Synthesized control oligonucleotide probe
atttcccatgcgagaggtagcttgcccaggctgttggata

SEQ ID NO: 7874 - DNA, 40 bp, Artificial Sequence
  Synthesized control oligonucleotide probe
ttccatgccgagtcctgatggaaactagcactgaaagacc

SEQ ID NO: 7875 - DNA, 40 bp, Artificial Sequence
  Synthesized control oligonucleotide probe
tcacgggagcttccttcactgagttctgcgaatctgaagc

SEQ ID NO: 7876 - DNA, 40 bp, Artificial Sequence
  Synthesized control oligonucleotide probe
tttccagagatgaagcactacccagtcttacccaagttcg

SEQ ID NO: 7877 - DNA, 40 bp, Artificial Sequence
  Synthesized control oligonucleotide probe
ccaccgagaacagtgatgaaggacttaaagtgagagatgg

SEQ ID NO: 7878 - DNA, 40 bp, Artificial Sequence
  Synthesized control oligonucleotide probe
gttcactcgtcggtttttcaccaaccacagactagcctca

SEQ ID NO: 7879 - DNA, 40 bp, Artificial Sequence
  Synthesized control oligonucleotide probe
acgcagctgtgttgagtgcacaggaagctcttagggttaa

SEQ ID NO: 7880 - DNA, 40 bp, Artificial Sequence
  Synthesized control oligonucleotide probe
tctcagtgaacagagggctcactgagaggactttgaatac

SEQ ID NO: 7881 - DNA, 40 bp, Artificial Sequence
  Synthesized control oligonucleotide probe
atggcacaggccacatactggaatgaatgacgggcttcat

SEQ ID NO: 7882 - DNA, 40 bp, Artificial Sequence
  Synthesized control oligonucleotide probe
tgctgcttgatggtggcatcactgtcccctcattccatga

SEQ ID NO: 7883 - DNA, 40 bp, Artificial Sequence
  Synthesized control oligonucleotide probe
ggacacatgtggacagtgtgaaacctcagaacactaaccc

SEQ ID NO: 7884 - DNA, 40 bp, Artificial Sequence
  Synthesized control oligonucleotide probe
aagttcttatccttagggacccagcggagaccttggttct

SEQ ID NO: 7885 - DNA, 40 bp, Artificial Sequence
  Synthesized control oligonucleotide probe
cgacgatgcctgggaataggatccatgggattgatgagaa

SEQ ID NO: 7886 - DNA, 40 bp, Artificial Sequence
  Synthesized control oligonucleotide probe
gggagccatgaagatttctcccagctcctgaggaactttg

SEQ ID NO: 7887 - DNA, 40 bp, Artificial Sequence
  Synthesized control oligonucleotide probe
tctggtcctcaagtcctcagctgtagaagttctcattgcg

SEQ ID NO: 7888 - DNA, 40 bp, Artificial Sequence
  Synthesized control oligonucleotide probe
tgccaaccctggaaactggcttgtgtgtccacaacagaaa

SEQ ID NO: 7889 - DNA, 40 bp, Artificial Sequence
  Synthesized control oligonucleotide probe
taggtgacagcactgtcctttccctgccatttgcagggaa

SEQ ID NO: 7890 - DNA, 40 bp, Artificial Sequence
  Synthesized control oligonucleotide probe
ttcttctagatggcagacattgttgaggcctcccgtacct

SEQ ID NO: 7891 - DNA, 40 bp, Artificial Sequence
  Synthesized control oligonucleotide probe
agagagctgcgagacaagacttggagtgcgacaagatttc

SEQ ID NO: 7892 - DNA, 40 bp, Artificial Sequence
  Synthesized control oligonucleotide probe
ttcaatcaggtactccgagttcccttggaggccaaaagga

SEQ ID NO: 7893 - DNA, 40 bp, Artificial Sequence
  Synthesized control oligonucleotide probe
aggaatatggggtccatctgagactcgcaagtgatgatac

SEQ ID NO: 7894 - DNA, 40 bp, Artificial Sequence
  Synthesized control oligonucleotide probe
gatctccaggaccagctctcagaaatgcacgatgaactgg

SEQ ID NO: 7895 - DNA, 40 bp, Artificial Sequence
  Synthesized control oligonucleotide probe
acagtgtgatggagcagcagtccaagttcatcctccaaga

SEQ ID NO: 7896 - DNA, 40 bp, Artificial Sequence
  Synthesized control oligonucleotide probe
aagatgacaggatccaggaaacaagacgcatgggccagaa

SEQ ID NO: 7897 - DNA, 40 bp, Artificial Sequence
  Synthesized control oligonucleotide probe
aaagagtgggtctgttaataatcaggccgagaccaccagc

SEQ ID NO: 7898 - DNA, 40 bp, Artificial Sequence
  Synthesized control oligonucleotide probe
cacccttgttcgtggcccttgcttggtaaactggtatcca

SEQ ID NO: 7899 - DNA, 40 bp, Artificial Sequence
  Synthesized control oligonucleotide probe
cccaagtatgggtgaggatgctagaaatgcccacataatg

SEQ ID NO: 7900 - DNA, 40 bp, Artificial Sequence
  Synthesized control oligonucleotide probe
aagactgtcattggtaggtcatgatccttggcagcatgac

SEQ ID NO: 7901 - DNA, 40 bp, Artificial Sequence
  Synthesized control oligonucleotide probe
gtggggacggtcattatcagctttctggacacacagacag

SEQ ID NO: 7902 - DNA, 40 bp, Artificial Sequence
  Synthesized control oligonucleotide probe
tgagaggccaaagaatatcagttgactctggatcaggggc

SEQ ID NO: 7903 - DNA, 40 bp, Artificial Sequence
  Synthesized control oligonucleotide probe
gaggctttttagggcagcgagaaaacgggaacttcattcc

SEQ ID NO: 7904 - DNA, 40 bp, Artificial Sequence
  Synthesized control oligonucleotide probe
aggacttctctggacctgtgcctcaactactcacctggat

SEQ ID NO: 7905 - DNA, 40 bp, Artificial Sequence
  Synthesized control oligonucleotide probe
tggccacaaatgttgcctccagctgctcaatgttctccaa

SEQ ID NO: 7906 - DNA, 40 bp, Artificial Sequence
  Synthesized control oligonucleotide probe
ctggcattggtgagtaataggagccagacgggtctgtgtt

SEQ ID NO: 7907 - DNA, 40 bp, Artificial Sequence
  Synthesized control oligonucleotide probe
atacttacctgcacgagaatgagtttggagcgcaaggggg

SEQ ID NO: 7908 - DNA, 40 bp, Artificial Sequence
  Synthesized control oligonucleotide probe
ttcccccagagactctgtccactatggacattaaaatgtg

SEQ ID NO: 7909 - DNA, 40 bp, Artificial Sequence
  Synthesized control oligonucleotide probe
gtgctaccctcctcccttcaggttatgtggtccaggcttt

SEQ ID NO: 7910 - DNA, 40 bp, Artificial Sequence
  Synthesized control oligonucleotide probe
taagtggaacaacattcccttcattatagcccttcgtggg

SEQ ID NO: 7911 - DNA, 40 bp, Artificial Sequence
  Synthesized control oligonucleotide probe
gcaacgtcaacaactactacgtgcacaagcgcctctactg

SEQ ID NO: 7912 - DNA, 40 bp, Artificial Sequence
  Synthesized control oligonucleotide probe
gcggatgtcgttatgggacaggtacaagtagataagttgc

SEQ ID NO: 7913 - DNA, 40 bp, Artificial Sequence
  Synthesized control oligonucleotide probe
gtggtcaccatctcttcaaaccatttggactgggcctggt

SEQ ID NO: 7914 - DNA, 40 bp, Artificial Sequence
  Synthesized control oligonucleotide probe
aagccaaggagttctgagagagcttagctaagttcttcgc

SEQ ID NO: 7915 - DNA, 40 bp, Artificial Sequence
  Synthesized control oligonucleotide probe
ttttttagtaccccagtgtgtaagaccaactgagggtggc

SEQ ID NO: 7916 - DNA, 40 bp, Artificial Sequence
  Synthesized control oligonucleotide probe
gttgtcattggggctatagacataagcaccttccggaatc

SEQ ID NO: 7917 - DNA, 40 bp, Artificial Sequence
  Synthesized control oligonucleotide probe
ctgagtgtgcgaggggaagatattggtgaagacctgttct

SEQ ID NO: 7918 - DNA, 40 bp, Artificial Sequence
  Synthesized control oligonucleotide probe
gtcagaccctgtcctcgtctcctttaccttgtctcgattt

SEQ ID NO: 7919 - DNA, 40 bp, Artificial Sequence
  Synthesized control oligonucleotide probe
taaactatgctcgccaccactcagcactcacctcttgggc

SEQ ID NO: 7920 - DNA, 40 bp, Artificial Sequence
  Synthesized control oligonucleotide probe
ggcaacttcctgagacagatcggtaaaaacaaccccttct

SEQ ID NO: 7921 - DNA, 40 bp, Artificial Sequence
  Synthesized control oligonucleotide probe
tcaactgtatttcatcagagagatgtggctttcccagaca

SEQ ID NO: 7922 - DNA, 40 bp, Artificial Sequence
  Synthesized control oligonucleotide probe
gtttccctcatgttcccccaggttctgtcaggtgaagctg

SEQ ID NO: 7923 - DNA, 40 bp, Artificial Sequence
  Synthesized control oligonucleotide probe
ttaacccatctctacccgtcctgtgtcaagaacggaggct

SEQ ID NO: 7924 - DNA, 40 bp, Artificial Sequence
  Synthesized control oligonucleotide probe
ctgcccaaaatagaaaccgaggttctccgtgacctacatc

SEQ ID NO: 7925 - DNA, 40 bp, Artificial Sequence
  Synthesized control oligonucleotide probe
ttcctttgcagtaacagcgggaacatgaagccgccactct

SEQ ID NO: 7926 - DNA, 40 bp, Artificial Sequence
  Synthesized control oligonucleotide probe
tggtttgccagttcagacacccagccaaattgccctctca

SEQ ID NO: 7927 - DNA, 40 bp, Artificial Sequence
  Synthesized control oligonucleotide probe
tagtgcagctggctttgagcctgttcccgaatgttcagat

SEQ ID NO: 7928 - DNA, 40 bp, Artificial Sequence
  Synthesized control oligonucleotide probe
agggtaatagcaccaagctctagtctacccacctctctga

SEQ ID NO: 7929 - DNA, 40 bp, Artificial Sequence
  Synthesized control oligonucleotide probe
ccgcatctctggagtaggaattgatcagccaccatatggg

SEQ ID NO: 7930 - DNA, 40 bp, Artificial Sequence
  Synthesized control oligonucleotide probe
ctatgagcatactggggagggaaacctctaagcggaactt

SEQ ID NO: 7931 - DNA, 40 bp, Artificial Sequence
  Synthesized control oligonucleotide probe
aaaaacctgcaggaaggagacctgaatgcaactgtgggtc

SEQ ID NO: 7932 - DNA, 40 bp, Artificial Sequence
  Synthesized control oligonucleotide probe
caggtgctccaaaccttccagtctatgttgtagattgcag

SEQ ID NO: 7933 - DNA, 40 bp, Artificial Sequence
  Synthesized control oligonucleotide probe
gccatactaacctacttctccttgaagctcttggcccatc

SEQ ID NO: 7934 - DNA, 40 bp, Artificial Sequence
  Synthesized control oligonucleotide probe
actgtgagatagccctcatcatcttcaacagcgccaaccg

SEQ ID NO: 7935 - DNA, 40 bp, Artificial Sequence
  Synthesized control oligonucleotide probe
agatacacggtcacagacgccatgtgttgtggcttctgca

SEQ ID NO: 7936 - DNA, 40 bp, Artificial Sequence
  Synthesized control oligonucleotide probe
cacatcctctcaccttttccgaaggttgcagctccttctc

SEQ ID NO: 7937 - DNA, 40 bp, Artificial Sequence
  Synthesized control oligonucleotide probe
tctgtctcaccggtcccttcattcctaggcaactgtagat

SEQ ID NO: 7938 - DNA, 40 bp, Artificial Sequence
  Synthesized control oligonucleotide probe
atatcatggtctgtatcccccaggtaccttgacacaggcc

SEQ ID NO: 7939 - DNA, 40 bp, Artificial Sequence
  Synthesized control oligonucleotide probe
ctctccgcctttctttagacctgagcatgcagaattccga

SEQ ID NO: 7940 - DNA, 40 bp, Artificial Sequence
  Synthesized control oligonucleotide probe
aaggcatttaaatgggacagcgtcccatgcgtgacttctc

SEQ ID NO: 7941 - DNA, 40 bp, Artificial Sequence
  Synthesized control oligonucleotide probe
tctttctaacagacgaacagcctacacctacaaccccgag

SEQ ID NO: 7942 - DNA, 40 bp, Artificial Sequence
  Synthesized control oligonucleotide probe
gtcccagcccaaaagcatcttgggtaaggatttgggatca

SEQ ID NO: 7943 - DNA, 40 bp, Artificial Sequence
  Synthesized control oligonucleotide probe
gttgttctgggccagtgttagttgctcacatgtcctgtct

SEQ ID NO: 7944 - DNA, 40 bp, Artificial Sequence
  Synthesized control oligonucleotide probe
aacatgcctcttagtcctgggccataccttagccttgtgc

SEQ ID NO: 7945 - DNA, 40 bp, Artificial Sequence
  Synthesized control oligonucleotide probe
taacctccaaaagaggtacccattggcgctcaaccgaatt

SEQ ID NO: 7946 - DNA, 40 bp, Artificial Sequence
  Synthesized control oligonucleotide probe
ctatatctccgactatgccttcttgggcactgcactgctg

SEQ ID NO: 7947 - DNA, 40 bp, Artificial Sequence
  Synthesized control oligonucleotide probe
tctagatggaagctgtatccaaggatgctccggaatgttg

SEQ ID NO: 7948 - DNA, 40 bp, Artificial Sequence
  Synthesized control oligonucleotide probe
atcttctctgcctgccgcactagcttcttggtgacttctc

SEQ ID NO: 7949 - DNA, 40 bp, Artificial Sequence
  Synthesized control oligonucleotide probe
atcgagttgtcgagccccatgattcgacaccaagatccca

SEQ ID NO: 7950 - DNA, 40 bp, Artificial Sequence
  Synthesized control oligonucleotide probe
aggtgcttgttttactctctccaggtgatgatgccaggga

SEQ ID NO: 7951 - DNA, 40 bp, Artificial Sequence
  Synthesized control oligonucleotide probe
gtgcactgtcagatcttggaaacggccaaaggatttttcc

SEQ ID NO: 7952 - DNA, 40 bp, Artificial Sequence
  Synthesized control oligonucleotide probe
cattttgcaggaggctgctaattaaggctgagggccatca

SEQ ID NO: 7953 - DNA, 40 bp, Artificial Sequence
  Synthesized control oligonucleotide probe
tcaatggtagactggagtaccttgccagggcagagaaaaa

SEQ ID NO: 7954 - DNA, 40 bp, Artificial Sequence
  Synthesized control oligonucleotide probe
ctcctccaggagctggcagcatcaagaccccacttcgctt

SEQ ID NO: 7955 - DNA, 40 bp, Artificial Sequence
  Synthesized control oligonucleotide probe
aaataatagcaggcgttgagatgtcccttccccagcactc

SEQ ID NO: 7956 - DNA, 40 bp, Artificial Sequence
  Synthesized control oligonucleotide probe
aagtctgacagcatctgcttgaactgaggcacagtgatgg

SEQ ID NO: 7957 - DNA, 40 bp, Artificial Sequence
  Synthesized control oligonucleotide probe
attcgtgatggcgctcatttccataaaggacgacaggtca

SEQ ID NO: 7958 - DNA, 40 bp, Artificial Sequence
  Synthesized control oligonucleotide probe
gaagagtgaattcccgcttctgcgccaacattctgtttcc

SEQ ID NO: 7959 - DNA, 40 bp, Artificial Sequence
  Synthesized control oligonucleotide probe
acaggtgaagtctttgcgtgcctccctgttggactcaaat

SEQ ID NO: 7960 - DNA, 40 bp, Artificial Sequence
  Synthesized control oligonucleotide probe
taatgatattctggcacaaggagcagagcccctcttcttc

SEQ ID NO: 7961 - DNA, 40 bp, Artificial Sequence
  Synthesized control oligonucleotide probe
agacccagcctacctgcatgatctcttgtacagctttgca

SEQ ID NO: 7962 - DNA, 40 bp, Artificial Sequence
  Synthesized control oligonucleotide probe
tcatggaacatgggccttgcaaaggggtcaagatcacaac

SEQ ID NO: 7963 - DNA, 40 bp, Artificial Sequence
  Synthesized control oligonucleotide probe
gtcaaaaaggtccaatcagctagagactaggccagaccca

SEQ ID NO: 7964 - DNA, 40 bp, Artificial Sequence
  Synthesized control oligonucleotide probe
tgtgaccaccctaaagggagggcagaagccgagtcaccct

SEQ ID NO: 7965 - DNA, 40 bp, Artificial Sequence
  Synthesized control oligonucleotide probe
acgcctccacctgctgctaggactcccctcccaaacaaag

SEQ ID NO: 7966 - DNA, 40 bp, Artificial Sequence
  Synthesized control oligonucleotide probe
cacagtctagaccctgatgggcgatctcagtagtgctgtt

SEQ ID NO: 7967 - DNA, 40 bp, Artificial Sequence
  Synthesized control oligonucleotide probe
cctatcaacgtgcaagtgggatttgtctccactggctttc

SEQ ID NO: 7968 - DNA, 40 bp, Artificial Sequence
  Synthesized control oligonucleotide probe
gaaaatcattccccattctgcaggatccgttcccctggca

SEQ ID NO: 7969 - DNA, 40 bp, Artificial Sequence
  Synthesized control oligonucleotide probe
agtgggacataccaacttgatgaggcagttgtgcgagttc

SEQ ID NO: 7970 - DNA, 40 bp, Artificial Sequence
  Synthesized control oligonucleotide probes
gtaaacagctgtcttcttaccctacagatcattgggcagg

SEQ ID NO: 7971 - DNA, 40 bp, Artificial Sequence
  Synthesized control oligonucleotide probe
cagaaggatactagaatggaatgtcctgcgtgacgaaagc

SEQ ID NO: 7972 - DNA, 40 bp, Artificial Sequence
  Synthesized control oligonucleotide probe
agttcacatctgattctcctatggctgctaggctccagga

The invention claimed is:

1. A method for performing a genetic analysis on a DNA target region from a test sample comprising a plurality of genomic DNA fragments, the method comprising: (a) generating a genomic DNA library by contacting the test sample with a set of adaptors, wherein each adaptor of the set of adaptors comprises a sample tag region selected from a pool of unique sample tag regions, wherein the pool is selected from a plurality of pools, and wherein the selected pool is unique to the test sample;
   wherein the genomic DNA library comprises a plurality of library DNA fragments and at least two unique sample tag regions;
   wherein each of the library DNA fragments comprises a genomic DNA fragment from the test sample attached to an adaptor;
   (b) contacting the genomic DNA library with a plurality of capture probes that specifically bind to the DNA target region, thereby forming complexes between the capture probes and library DNA fragments comprising the DNA target region; and
   (c) performing a quantitative genetic analysis of the genomic DNA fragments comprising the DNA target region;
   wherein the adaptor is a DNA polynucleotide that comprises: (i) an amplification region, (ii) a sample tag region, and (iii) an anchor region;
   wherein the amplification region comprises a polynucleotide sequence capable of serving as a primer recognition site for PCR amplification;
   wherein the sample tag region identifies the test sample; and
   wherein the anchor region comprises a polynucleotide sequence that is capable of attaching to the genomic DNA fragment.

2. The method of claim 1, wherein the method identifies a genetic change indicative of a disease state selected from a single nucleotide variant (SNV), an insertion less than 40 nucleotides in length, a deletion of a DNA region less than 40 nucleotides in length, and/or a change in copy number.

3. The method of claim 2, wherein the genetic change indicative of a disease state is a change in copy number.

4. The method of claim 1, wherein the test sample is a tissue biopsy.

5. The method of claim 4, wherein the tissue biopsy is taken from a tumor or a tissue suspected of being a tumor.

6. The method of claim 1, wherein the genomic DNA fragments are cell free DNA (cfDNA) or cellular DNA.

7. The method of claim 6, wherein the genomic DNA fragments are isolated from the test sample; and wherein the test sample is a biological sample selected from the group consisting of: amniotic fluid, blood, plasma, serum, semen, lymphatic fluid, cerebral spinal fluid, ocular fluid, urine, saliva, stool, mucous, and sweat.

8. The method of claim 1, wherein the genomic DNA fragments are obtained by the steps comprising;
   (i) isolating cellular DNA from the test sample;
   (ii) fragmenting the cellular DNA to obtain the genomic DNA fragments.

9. The method of claim 8, wherein step (ii) is performed by contacting the cellular DNA with at least one digestion enzyme.

10. The method of claim 8, wherein step (ii) is performed by applying mechanical stress to the cellular DNA.

11. The method of claim 10, where the mechanical stress is applied by sonicating the cellular DNA.

12. The method of claim 1, wherein the amplification region is between 10 and 50 nucleotides in length.

13. The method of claim 1, wherein the amplification region is between 20 and 30 nucleotides in length.

14. The method of claim 1, wherein the amplification region is 25 nucleotides in length.

15. The method of claim 1, wherein the sample tag region is between 5 and 50 nucleotides in length.

16. The method of claim 15, wherein the sample tag region is between 5 and 15 nucleotides in length.

17. The method of claim 15, wherein the sample tag region is 8 nucleotides in length.

18. The method of claim 1, wherein the adaptor further comprises a unique molecule identifier multiplier (UMI multiplier) that is adjacent to or contained within the sample tag region.

19. The method of claim 18, wherein the UMI multiplier is between 1 and 5 nucleotides in length.

20. The method of claim 18, wherein the UMI multiplier is 3 nucleotides in length, and comprises one of 64 possible nucleotide sequences.

21. The method of claim 1, wherein the anchor region is between 1 and 50 nucleotides in length.

22. The method of claim 21, wherein the anchor region is between 5 and 25 nucleotides in length.

23. The method of claim 21, wherein the anchor region is 10 nucleotides in length.

24. The method of claim 1, wherein step (a) comprises attaching a first adaptor to one end of a genomic DNA fragment of the test sample and attaching a second adaptor to the other end of the genomic DNA fragment.

25. The method of claim 24, wherein the genomic DNA fragment is end repaired prior to attaching the first and second adaptors.

26. The method of claim 1, wherein the amplification region of each adaptor of the set of adaptors is identical to the amplification region of every other adaptor of the set of adaptors.

27. The method of claim 1, wherein the pool of sample tag regions comprises between 2 and 1,000 unique sample tag region sequences.

28. The method of claim 27, wherein the pool of sample tag regions comprises between 50 and 500 unique sample tag region sequences.

29. The method of claim 27, wherein the pool of sample tag regions comprises between 100 and 400 unique sample tag region sequences.

30. The method of claim 27, wherein the pool of sample tag regions comprises between 200 and 300 unique sample tag region sequences.

31. The method of claim 27, wherein each sample tag region of the pool of sample tag regions is 8 nucleotides in length.

32. The method of claim 27, wherein the pool of sample tag regions comprises 240 unique sample tag region sequences.

33. The method of claim 27, wherein each unique sample tag region sequence is discrete from any other unique sample tag region sequence by Hamming distance of at least two.

34. The method of claim 1, wherein the sample tag region identifies the genomic DNA fragment attached thereto.

35. The method of claim 34, wherein the adaptor further comprises a UMI multiplier which increases the number of unique sequences for identifying the genomic fragments.

36. The method of claim 1, wherein the anchor region of each adaptor of the set of adaptors comprises one of four sequences, and wherein each sample tag region of a given sequence is paired to only one of the four anchor regions of a given sequence.

37. The method of claim 1, wherein the amplification region of each adaptor of the set of adaptors comprises an identical nucleotide sequence;
   wherein each sample tag region of the pool of sample tag regions is 8 nucleotides in length, wherein each unique sample tag region sequence is discrete from any other unique sample tag region sequence by Hamming distance of at least two,
   wherein each adaptor of the set of adaptors comprises a UMI multiplier that is adjacent to or contained within the sample tag region, wherein the UMI multiplier of each adaptor of the set of adaptors is three nucleotides in length, and wherein the UMI multiplier of a given sequence is paired to one sample tag region of a given sequence,
   wherein the anchor region of each adaptor of the set of adaptors comprises one of four nucleotide sequences, and wherein each sample tag region of a given sequence is paired to only one of the four anchor regions of a given sequence.

38. The method of claim 24, wherein the step of attaching each of the first and second adaptors to the genomic DNA fragment comprises:
   (i) attaching an oligonucleotide comprising at least a portion of an anchor region to the genomic DNA fragment, wherein the oligonucleotide is part of a DNA duplex comprising a 5' phosphorylated attachment strand duplexed with a partner strand, wherein the partner strand is blocked from attachment to the genomic DNA fragment by chemical modification at its 3' end, and wherein the attachment strand is attached to the genomic DNA fragment; and
   (ii) contacting the genomic DNA fragment attached to the attachment strand with a DNA oligonucleotide encoding a full-length adaptor sequence, a T4 polynucleotide kinase, a Taq DNA ligase, and a full-length Bst polymerase under conditions suitable for DNA ligation;

thereby attaching each of the first and second adaptors to the genomic DNA fragment.

39. The method of claim 1, wherein the DNA target region is analyzed for a change in copy number.

40. The method of claim 1, wherein step (c) comprises purification of the complexes formed between the capture probes and DNA library fragments comprising the DNA target region.

41. The method of claim 1, wherein step (c) comprises purification of the complexes formed between the capture probes and DNA library fragments comprising the DNA target region and performing primer extension and/or amplification of the DNA library fragments comprising the DNA target region.

42. The method of claim 1, wherein step (c) comprises purification of the complexes formed between the capture probes and DNA library fragments comprising the DNA target region and performing primer extension and amplification of the DNA library fragments comprising the DNA target region.

43. The method of claim 1, wherein step (c) comprises DNA sequencing of the DNA library fragments comprising the DNA target region to generate a plurality of sequencing reads.

44. The method of claim 1, wherein the genomic analysis comprises determining a change of a copy number in a DNA region of interest, and wherein step (c) comprises:
   (i) determining a copy number of the region of interest present in the genomic DNA library derived from the test sample, and
   (ii) comparing the copy number determined in step (i) to a copy number of the region of interest present in a genomic DNA library derived from a reference sample, wherein the reference sample comprises a known copy number of the DNA target region.

45. The method of claim 44, wherein determining the copy number in the region of interest comprises DNA sequencing of the DNA library fragments comprising the DNA target region to generate a plurality of sequencing reads, wherein each sequencing read comprises a unique molecular identification element (UMIE).

46. The method of claim 45, wherein the UMIE comprises sequencing information from the adaptor and at least a portion of the genomic DNA fragment sequence.

47. The method of claim 46, wherein sequencing reads comprising identical UMIEs are identified as a unique genomic sequence (UGS).

48. The method of claim 44, further comprising determining a raw genomic depth (RGD) for each of the capture probes contacted with the genomic DNA library.

49. The method of claim 48, wherein determining the RGD comprises determining the average number of UGSs associated with each capture probe sequence within a group of sample replicates.

50. The method of claim 49, wherein capture probes associated with a highly variable number of UGSs are identified as noisy probes and are removed from further calculations.

51. The method of claim 49, further comprising calculating an RGD for a sample, comprising calculating a numerical average of all RGDs for all capture probes in the sample.

52. The method of claim 49, wherein the RGD values for noisy probes are not included in calculating an RGD for a sample.

53. The method of claim 48, wherein the RGDs for the capture probes are normalized across all samples in an experimental group by converting the RGD for each capture probe into a probe-specific, normalized read count comprising:
   (i) multiplying each capture probe RGD in a sample by a normalization constant, wherein the normalization constant comprises any real number; and
   (ii) dividing the product of (i) by the RGD calculated for the corresponding sample; or
   (iii) dividing the product of (i) by an average RGD calculated from a subset of probes.

54. The method of claim 53, wherein the subset of probes is a set of control probes.

55. The method of claim 54, wherein the probe-specific, normalized read counts are converted to a copy number value comprising:
   (i) multiplying the probe-specific, normalized read counts of probes directed to autosomal and/or X-linked regions by 2 in samples derived from females;
   (ii) multiplying the probe-specific, normalized read counts of probes directed to Y-linked and/or X-linked regions by 1 in samples derived from males;
   (iii) averaging the products of (i) and/or (ii) across all samples in an experiment; and
   (iv) dividing the product of (i) and/or (ii) by the average of (iii).

56. The method of claim 55, wherein the approximate copy number values for all probes that target a specific gene are averaged.

* * * * *